(12) United States Patent
Bui

(10) Patent No.: US 12,384,814 B2
(45) Date of Patent: Aug. 12, 2025

(54) COMPOUNDS AND METHODS FOR REDUCING APP EXPRESSION

(71) Applicant: Ionis Pharmaceuticals, Inc., Carlsbad, CA (US)

(72) Inventor: Huynh-Hoa Bui, San Diego, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 0 days.

(21) Appl. No.: 17/387,727

(22) Filed: Jul. 28, 2021

(65) Prior Publication Data

US 2023/0055405 A1    Feb. 23, 2023

Related U.S. Application Data

(60) Provisional application No. 63/148,514, filed on Feb. 11, 2021, provisional application No. 63/129,255, filed on Dec. 22, 2020, provisional application No. 63/106,616, filed on Oct. 28, 2020, provisional application No. 63/057,816, filed on Jul. 28, 2020.

(51) Int. Cl.
*C12N 15/113* (2010.01)
*C07H 21/02* (2006.01)

(52) U.S. Cl.
CPC .......... *C07H 21/02* (2013.01); *C12N 15/113* (2013.01); *C12N 2310/11* (2013.01); *C12N 2310/14* (2013.01); *C12N 2310/315* (2013.01); *C12N 2310/321* (2013.01); *C12N 2310/3341* (2013.01); *C12N 2310/341* (2013.01); *C12N 2320/30* (2013.01)

(58) Field of Classification Search
CPC .. C07H 21/02; C07H 14/4711; C12N 15/113; C12N 2310/11; C12N 2310/14; C12N 2310/315; C12N 2310/321; C12N 2310/3341; C12N 2310/341; C12N 2320/30

See application file for complete search history.

(56) References Cited

U.S. PATENT DOCUMENTS

| | | | |
|---|---|---|---|
| 3,687,808 | A | 8/1972 | Merigan et al. |
| 4,415,732 | A | 11/1983 | Caruthers et al. |
| 4,469,863 | A | 9/1984 | Ts'o et al. |
| 4,476,301 | A | 10/1984 | Imbach et al. |
| 4,500,707 | A | 2/1985 | Caruthers et al. |
| 4,725,677 | A | 2/1988 | Koster et al. |
| 4,845,205 | A | 7/1989 | Huynh Dinh et al. |
| 4,973,679 | A | 11/1990 | Caruthers et al. |
| 4,981,957 | A | 1/1991 | Lebleu et al. |
| 5,013,830 | A | 5/1991 | Ohutsuka et al. |
| 5,023,243 | A | 6/1991 | Tullis |
| 5,034,506 | A | 7/1991 | Summerton et al. |
| 5,118,800 | A | 6/1992 | Smith et al. |
| 5,130,302 | A | 7/1992 | Spielvogel et al. |
| 5,132,418 | A | 7/1992 | Caruthers et al. |
| 5,134,066 | A | 7/1992 | Rogers et al. |
| RE34,036 | E | 8/1992 | McGeehan |
| 5,149,797 | A | 9/1992 | Pederson et al. |
| 5,166,315 | A | 11/1992 | Summerton et al. |
| 5,175,273 | A | 12/1992 | Bischofberger et al. |
| 5,177,196 | A | 1/1993 | Meyer, Jr. et al. |
| 5,177,198 | A | 1/1993 | Spielvogel et al. |
| 5,188,897 | A | 2/1993 | Suhadolnik et al. |
| 5,194,599 | A | 3/1993 | Froehler et al. |
| 5,214,134 | A | 5/1993 | Weis et al. |
| 5,216,141 | A | 6/1993 | Benner |
| 5,220,007 | A | 6/1993 | Pederson et al. |
| 5,223,618 | A | 6/1993 | Cook et al. |
| 5,235,033 | A | 8/1993 | Summerton et al. |
| 5,256,775 | A | 10/1993 | Froehler |
| 5,264,423 | A | 11/1993 | Cohen et al. |
| 5,264,562 | A | 11/1993 | Matteucci |
| 5,264,564 | A | 11/1993 | Matteucci |
| 5,185,444 | A | 12/1993 | Summerton et al. |
| 5,276,019 | A | 1/1994 | Cohen et al. |
| 5,286,717 | A | 2/1994 | Cohen et al. |

(Continued)

FOREIGN PATENT DOCUMENTS

| | | |
|---|---|---|
| EP | 2601294 | 11/2018 |
| WO | WO 1989/006693 | 7/1989 |

(Continued)

OTHER PUBLICATIONS

Nguyen, K V, beta-Amyloid precursor protein (APP) and the human diseases, Oct. 29, 2019, AIMS Neuroscience, 6: 273-281 (Year: 2019).*
Stein, et al. Beta-amyloid deposition in chronic traumatic encephalpathy, 2015, Acta Neuropathol., 130, 21-34. (Year: 2015).*
Grabowska-Pyrzewicz, W. et al, Antisense oligonucleotides for Alzheimer's disease therapy: from the mRNA to miRNA paradigm, 2021, EbioMedicine, 74, 1-10. (Year: 2021).*
Zheng and Koo, The amyloid precursor protein: beyond amyloid, 2006, Molecular Neurodegeneration, 1, 5, p. 1-12 (Year: 2006).*
Roberts et al., Advances in oligonucleotide drug delivery, 2020, Nature Reviews, 19, p. 673-694 (Year: 2020).*

(Continued)

*Primary Examiner* — Soren Harward
*Assistant Examiner* — Keyur A Vyas
(74) *Attorney, Agent, or Firm* — McNeill PLLC

(57) ABSTRACT

Provided are compounds, methods, and pharmaceutical compositions for reducing the amount or activity of APP RNA in a cell or animal, and in certain instances reducing the amount of APP protein in a cell or animal. Such compounds, methods, and pharmaceutical compositions are useful to ameliorate at least one symptom or hallmark of a neurodegenerative disease or disorder. Such symptoms and hallmarks include cognitive impairment, including a decline in memory and language skills, behavioral and psychological symptoms such as apathy and lack of motivation, gait disturbances and seizures, progressive dementia, and abnormal amyloid deposits.

32 Claims, No Drawings

Specification includes a Sequence Listing.

(56) References Cited

U.S. PATENT DOCUMENTS

| | | |
|---|---|---|
| 5,319,080 A | 6/1994 | Leumann |
| 5,321,131 A | 6/1994 | Agrawal et al. |
| 5,359,044 A | 10/1994 | Cook et al. |
| 5,366,878 A | 11/1994 | Pederson et al. |
| 5,367,066 A | 11/1994 | Urdea et al. |
| 5,378,825 A | 1/1995 | Cook et al. |
| 5,386,023 A | 1/1995 | Sanghvi et al. |
| 5,393,878 A | 2/1995 | Leumann |
| 5,399,676 A | 3/1995 | Froehler |
| 5,403,711 A | 4/1995 | Walder et al. |
| 5,405,938 A | 4/1995 | Sumerton et al. |
| 5,405,939 A | 4/1995 | Suhadolnik et al. |
| 5,432,272 A | 7/1995 | Benner |
| 5,434,257 A | 7/1995 | Matteucci |
| 5,446,137 A | 8/1995 | Maag et al. |
| 5,453,496 A | 9/1995 | Caruthers et al. |
| 5,455,233 A | 10/1995 | Spielvogel et al. |
| 5,457,187 A | 10/1995 | Gmelner et al. |
| 5,457,191 A | 10/1995 | Cook et al. |
| 5,459,255 A | 10/1995 | Cook et al. |
| 5,466,677 A | 11/1995 | Baxter et al. |
| 5,466,786 A | 11/1995 | Burh et al. |
| 5,470,967 A | 11/1995 | Huie et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,491,133 A | 2/1996 | Walder et al. |
| 5,502,177 A | 3/1996 | Matteucci et al. |
| 5,508,270 A | 4/1996 | Baxter et al. |
| 5,514,785 A | 5/1996 | Van Ness et al. |
| 5,519,126 A | 5/1996 | Hecht |
| 5,519,134 A | 5/1996 | Acevedo et al. |
| 5,525,711 A | 6/1996 | Hawkins et al. |
| 5,527,899 A | 6/1996 | Froehler |
| 5,536,821 A | 7/1996 | Agrawal et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,552,540 A | 9/1996 | Haralambidis |
| 5,561,225 A | 10/1996 | Maddry et al. |
| 5,563,253 A | 10/1996 | Agrawal et al. |
| 5,565,350 A | 10/1996 | Kmiec |
| 5,565,555 A | 10/1996 | Froehler et al. |
| 5,567,811 A | 10/1996 | Mistura et al. |
| 5,571,799 A | 11/1996 | Tkachuk et al. |
| 5,576,427 A | 11/1996 | Cook et al. |
| 5,587,361 A | 12/1996 | Cook et al. |
| 5,587,469 A | 12/1996 | Cook et al. |
| 5,587,470 A | 12/1996 | Cook et al. |
| 5,591,722 A | 1/1997 | Montgomery et al. |
| 5,594,121 A | 1/1997 | Froehler et al. |
| 5,596,086 A | 1/1997 | Matteucci |
| 5,596,091 A | 1/1997 | Switzer |
| 5,597,909 A | 1/1997 | Urdea et al. |
| 5,602,240 A | 2/1997 | De Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bishofberger et al. |
| 5,639,873 A | 6/1997 | Barascut et al. |
| 5,645,985 A | 7/1997 | Froehler et al. |
| 5,646,265 A | 7/1997 | McGee |
| 5,646,269 A | 7/1997 | Matteucci |
| 5,652,355 A | 7/1997 | Metelev et al. |
| 5,652,356 A | 7/1997 | Agrawal |
| 5,663,312 A | 9/1997 | Chaturvedula |
| 5,670,633 A | 9/1997 | Cook et al. |
| 5,670,634 A | 9/1997 | Marotta et al. |
| 5,672,697 A | 9/1997 | Buhr et al. |
| 5,677,437 A | 10/1997 | Teng et al. |
| 5,677,439 A | 10/1997 | Weis et al. |
| 5,681,941 A | 10/1997 | Cook et al. |
| 5,698,685 A | 12/1997 | Summerton et al. |
| 5,700,920 A | 12/1997 | Altmann et al. |
| 5,700,922 A | 12/1997 | Cook |
| 5,721,218 A | 2/1998 | Froehler |
| 5,750,692 A | 5/1998 | Cook et al. |
| 5,763,588 A | 6/1998 | Matteucci et al. |
| 5,792,608 A | 8/1998 | Swaminathan et al. |
| 5,792,847 A | 8/1998 | Burh et al. |
| 5,801,154 A | 9/1998 | Baracchini et al. |
| 5,808,027 A | 9/1998 | Cook et al. |
| 5,830,653 A | 11/1998 | Froehler et al. |
| 5,837,449 A | 11/1998 | Monia et al. |
| 5,859,221 A | 1/1999 | Cook et al. |
| 5,912,410 A | 6/1999 | Cordell |
| 5,948,903 A | 9/1999 | Cook et al. |
| 5,994,517 A | 11/1999 | Ts'O |
| 6,005,087 A | 12/1999 | Cook et al. |
| 6,005,096 A | 12/1999 | Matteucci et al. |
| 6,166,199 A | 12/2000 | Cook et al. |
| 6,177,246 B1 | 1/2001 | Monia et al. |
| 6,300,319 B1 | 10/2001 | Manoharan |
| 6,310,048 B1 | 10/2001 | Kumar et al. |
| 6,426,220 B1 | 7/2002 | Bennett et al. |
| 6,525,191 B1 | 2/2003 | Ramasamy |
| 6,531,584 B1 | 3/2003 | Cook et al. |
| 6,582,908 B2 | 6/2003 | Fodor et al. |
| 6,600,032 B1 | 7/2003 | Manoharan et al. |
| 6,660,720 B2 | 12/2003 | Manoharan |
| 6,699,671 B1 | 3/2004 | Gurney et al. |
| 6,770,748 B2 | 8/2004 | Imanishi et al. |
| 7,015,315 B1 | 3/2006 | Cook et al. |
| 7,053,207 B2 | 5/2006 | Wengel et al. |
| 7,101,993 B1 | 9/2006 | Cook et al. |
| 7,262,177 B2 | 8/2007 | Ts'o et al. |
| 7,399,845 B2 | 7/2008 | Seth et al. |
| 7,427,672 B2 | 9/2008 | Imanishi et al. |
| 7,491,805 B2 | 2/2009 | Vargeese et al. |
| 7,547,684 B2 | 6/2009 | Seth et al. |
| 7,569,686 B1 | 8/2009 | Bhat et al. |
| 7,635,771 B2 | 12/2009 | Khvorova et al. |
| 7,666,854 B2 | 2/2010 | Seth et al. |
| 7,696,345 B2 | 4/2010 | Allerson et al. |
| 7,723,509 B2 | 5/2010 | Manoharan et al. |
| 7,741,457 B2 | 6/2010 | Swayze et al. |
| 7,750,131 B2 | 7/2010 | Seth et al. |
| 7,829,696 B2 | 11/2010 | Khvorova et al. |
| 7,875,733 B2 | 1/2011 | Bhat et al. |
| 7,939,677 B2 | 5/2011 | Bhat et al. |
| 8,022,193 B2 | 9/2011 | Swayze et al. |
| 8,030,467 B2 | 10/2011 | Seth et al. |
| 8,080,644 B2 | 12/2011 | Wengel et al. |
| 8,088,746 B2 | 1/2012 | Seth et al. |
| 8,088,904 B2 | 1/2012 | Swayze et al. |
| 8,106,022 B2 | 1/2012 | Manoharan et al. |
| 8,124,745 B2 | 2/2012 | Allerson et al. |
| 8,153,365 B2 | 4/2012 | Wengel et al. |
| 8,268,980 B2 | 9/2012 | Seth et al. |
| 8,268,985 B2 | 9/2012 | Khvorova et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,283,517 B2 | 10/2012 | Schilling et al. |
| 8,440,803 B2 | 5/2013 | Swayze et al. |
| 8,501,805 B2 | 8/2013 | Seth et al. |
| 8,530,640 B2 | 9/2013 | Seth et al. |
| 8,546,556 B2 | 10/2013 | Seth et al. |
| RE44,779 E | 2/2014 | Imanishi et al. |
| 8,658,784 B2 | 2/2014 | Khvorova et al. |
| 8,673,560 B2 | 3/2014 | Leamon et al. |
| 8,828,956 B2 | 9/2014 | Manoharan et al. |
| 9,005,906 B2 | 4/2015 | Swayze et al. |
| 9,012,421 B2 | 4/2015 | Migawa et al. |
| 9,127,276 B2 | 8/2015 | Prakash et al. |
| 9,290,760 B2 | 3/2016 | Rajeev et al. |
| 10,364,432 B2 | 7/2019 | Van Roon-mom et al. |
| 10,900,041 B2 | 1/2021 | De Vlaam et al. |

(56) References Cited

U.S. PATENT DOCUMENTS

| | | |
|---|---|---|
| 11,732,260 B2 | 8/2023 | Rigo et al. |
| 2001/0053519 A1 | 12/2001 | Fodor et al. |
| 2003/0158403 A1 | 8/2003 | Manoharan et al. |
| 2003/0175906 A1 | 9/2003 | Manoharan et al. |
| 2003/0221204 A1 | 11/2003 | Golde et al. |
| 2003/0228597 A1 | 12/2003 | Cowsert et al. |
| 2003/0232435 A1 | 12/2003 | Dobie |
| 2004/0171570 A1 | 9/2004 | Allerson et al. |
| 2005/0043264 A1 | 2/2005 | Juang et al. |
| 2005/0130923 A1 | 6/2005 | Bhat et al. |
| 2005/0209179 A1 | 9/2005 | McSwiggen et al. |
| 2006/0148740 A1 | 7/2006 | Platenburg |
| 2006/0172964 A1 | 8/2006 | Tanzi et al. |
| 2006/0247194 A1 | 11/2006 | McSwiggen et al. |
| 2007/0031844 A1 | 2/2007 | Khvorova et al. |
| 2007/0032443 A1 | 2/2007 | Kim et al. |
| 2008/0039618 A1 | 2/2008 | Allerson et al. |
| 2009/0023158 A1 | 1/2009 | Paul et al. |
| 2010/0190807 A1 | 7/2010 | Porter et al. |
| 2010/0190837 A1 | 7/2010 | Migawa et al. |
| 2010/0197762 A1 | 8/2010 | Swayze et al. |
| 2011/0166197 A1 | 7/2011 | Darling et al. |
| 2013/0011887 A1 | 1/2013 | Dayton et al. |
| 2013/0130378 A1 | 5/2013 | Manoharan et al. |
| 2014/0107330 A1 | 4/2014 | Freier et al. |
| 2015/0018540 A1 | 1/2015 | Prakash et al. |
| 2015/0184153 A1 | 7/2015 | Freier et al. |
| 2015/0191727 A1 | 7/2015 | Migawa et al. |
| 2015/0267195 A1 | 9/2015 | Seth et al. |
| 2015/0275212 A1 | 10/2015 | Albaek et al. |
| 2016/0186175 A1 | 6/2016 | Seth et al. |
| 2016/0238606 A1 | 8/2016 | McNeel et al. |
| 2017/0044526 A1 | 2/2017 | Wan et al. |
| 2017/0240888 A1 | 8/2017 | Tremblay et al. |
| 2021/0040480 A1 | 2/2021 | Rigo et al. |

FOREIGN PATENT DOCUMENTS

| | | |
|---|---|---|
| WO | WO 1993/013114 | 7/1993 |
| WO | WO 1995/009236 | 4/1995 |
| WO | WO 2001/042266 | 6/2001 |
| WO | WO 2001/050829 | 7/2001 |
| WO | WO 2004/045543 | 6/2004 |
| WO | WO 2005/003350 | 1/2005 |
| WO | WO 2005/042777 | 5/2005 |
| WO | WO 2005/116204 | 12/2005 |
| WO | WO 2009/105572 | 8/2009 |
| WO | WO 2012/018257 | 2/2012 |
| WO | WO 2013/173635 | 11/2013 |
| WO | WO 2013/173637 | 11/2013 |
| WO | WO 2014/144942 | 9/2014 |
| WO | 2014197826 A1 | 12/2014 |
| WO | 2015023941 A1 | 2/2015 |
| WO | 2015054676 A2 | 4/2015 |
| WO | WO 2017/064308 | 4/2017 |
| WO | WO 2019/037133 | 2/2019 |
| WO | WO 2019/143978 | 7/2019 |
| WO | WO 2019/162692 | 8/2019 |
| WO | WO 2019/169243 | 9/2019 |
| WO | WO 2020/006267 | 1/2020 |
| WO | WO 2020/124257 | 6/2020 |
| WO | WO 2020/132227 | 6/2020 |
| WO | WO 2020/160163 | 8/2020 |
| WO | WO 2020/257194 | 12/2020 |
| WO | WO 2022/026589 | 2/2022 |

OTHER PUBLICATIONS

International Search Report for PCT/US21/043520 dated Jan. 5, 2022.
Ostergaard et al., "Understanding the effect of controlling phosphorothioate chirality in the DNA gap on the potency and safety of gapmer antisense oligonucleotides" Nucleic Acids Res (2020) 48: 1691-1700.
Allinquant et al., "Downregulation of amyloid precursor protein inhibits neurite outgrowth in vitro" J Cell Biol (1995) 128: 919-927.
Ali et al., "Nitric oxide activity and isoenzyme expression in the senescence-accelerated mouse p8 model of Alzheimer's disease: effects of anti-amyloid antibody and antisense treatments" J Gerontol A Biol Sci Med Sci (2009) 64: 1025-1030.
Armbrecht et al., "Antisense against Amyloid-β Protein Precursor Reverses Memory Deficits and Alters Gene Expression in Neurotropic and Insulin-Signaling Pathways in SAMP8 Mice" J Alzheimers Dis (2015) 46: 535-548.
Banks et al., "Delivery across the blood-brain barrier of antisense directed against amyloid beta: reversal of learning and memory deficits in mice overexpressing amyloid precursor protein" J Pharmacol Exp Ther (2001) 297: 1113-1121.
Bernstein et al., "Role for a bidentate ribonuclease in the initiation step of RNA interference" Nature (2001) 409: 363-366.
Branch et al., "A good antisense molecule is hard to find," TIBS (1998) 23:45-50.
Chang et al., "Targeting Amyloid-β Precursor Protein, APP, Splicing with Antisense Oligonucleotides Reduces Toxic Amyloid-β Production" Mol Ther (2018) 26: 1539-1551.
Chang et al., "Inhibition of the NGF and IL-1beta-induced expression of Alzheimer's amyloid precursor protein by antisense oligonucleotides" J Mol Neurosci (1999) 12: 69-74.
Chauhan et al., "Antisense inhibition at the beta-secretase-site of beta-amyloid precursor protein reduces cerebral amyloid and acetyl cholinesterase activity in Tg2576" Neuroscience (2007) 146: 143-151.
Chauhan "Trafficking of intracerebroventricularly injected antisense oligonucleotides in the mouse brain" Antisense Nucleic Acid Drug Dev (2002) 12: 353-357.
Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.
Coulson et al., "Down-regulation of the amyloid protein precursor of Alzheimer's disease by antisense oligonucleotides reduces neuronal adhesion to specific substrata" Brain Res (1997) 770: 72-80.
Crooke et al., "Basic Principles of Antisense Therapeutics" Antisense Research and Application (1998) Chapter 1:1-50.
Crooke, St., et al., "Antisense Drug Technology" Second Edition, CRC Press (2008) Chapters 1-28.
Currie et al., "Reduction of histone cytotoxicity by the Alzheimer beta-amyloid peptide precursor" Biochim Biophys Acta (1997) 1355: 248-258.
Dawson et al., "Age-related cognitive deficits, impaired long-term potentiation and reduction in synaptic marker density in mice lacking the beta-amyloid precursor protein" Neuroscience (1999) 90: 1-13.
Denman et al., "Facilitator oligonucleotides increase ribozyme RNA binding to full-length RNA substrates in vitro" FEBS Lett (1996) 382: 116-120.
Denman et al. "Hairpin ribozyme specificity in vivo: a case of promiscuous cleavage" Biochem Biophys Res Commun (1999) 257: 356-360.
Denman et al., "Differential activity of trans-acting hammerhead ribozymes targeted to beta amyloid peptide precursor mRNA by altering the symmetry of helices I and III" Arch Biochem Biophys (1995) 323: 71-78.
Denman et al. "Facilitated reduction of beta-amyloid peptide precursor by synthetic oligonucleotides in COS-7 cells expressing a hammerhead ribozyme" Arch Biochem Biophys (1997) 348: 82-90.
Dewachter et al., "Modeling Alzheimer's disease in transgenic mice: effect of age and of presenilin1 on amyloid biochemistry and pathology in APP/London mice" Exp Gerontol (2000) 35: 831-841.
Dingwall "Spotlight on BACE: the secretases as targets for treatment in Alzheimer disease" J Clin Invest (2001) 108: 1243-1246.
Dolzhanskaya et al., "In vivo ribozyme targeting of betaAPP+ mRNAs" Mol Cell Biol Res Commun (2000) 4: 239-247.
Dolzhanskaya et al., "Self-cleaving-ribozyme-mediated reduction of betaAPP in human rhabdomyosarcoma cells" Arch Biochem Biophys (2001) 387: 223-232.

(56) References Cited

OTHER PUBLICATIONS

Egli, et al., "Synthesis, improved antisense activity and structural rationale for the divergent RNA affinities of 3'-fluoro hexitol nucleic acid (FHNA and Ara-FHNA) modified oligonucleotides." J Am Chem (2011) 133(41):16642-16649.

Elbashir et al., "RNA interference is mediated by 21- and 22-nucleotide RNAs" Genes Dev (2001) 15: 188-200.

Erickson et al., "Inflammation-induced dysfunction of the low-density lipoprotein receptor-related protein-1 at the blood-brain barrier: protection by the antioxidant N-acetylcysteine" Brain Behav Immun (2012) 26: 1085-1094.

Farr et al., "Central and peripheral administration of antisense oligonucleotide targeting amyloid-β protein precursor improves learning and memory and reduces neuroinflammatory cytokines in Tg2576 (AβPPswe) mice" J Alzheimers Dis (2014) 40: 1005-1016.

Feng et al., "Allele-specific silencing of Alzheimer's disease genes: the amyloid precursor protein genes with Swedish or London mutations" Gene (2006) 371: 68-74.

Gautschi et al., "Activity of a novel bcl-2/bcl-xL bispecific antisense oligonucleotide against tumors of diverse histologic origins" J. Natl. Cancer Inst. (2001) 93:463-471.

Harper et al., "Mouse cortical neurones lacking APP show normal neurite outgrowth and survival responses in vitro" Neuroreport (1998) 9: 3053-3058.

Hoffmann et al., "A possible role for the Alzheimer amyloid precursor protein in the regulation of epidermal basal cell proliferation" Eur J Cell Biol (2000) 79: 905-914.

International Search Report for PCT/US19/020246 dated May 10, 2019.

International Search Report for PCT/US20/015701 dated Jun. 23, 2020.

Kibbey et al., "beta-Amyloid precursor protein binds to the neurite-promoting IKVAV site of laminin" Proc Natl Acad Sci (1993) 90: 10150-10153.

Kienlen-Campard et al., "The processing and biological function of the human amyloid precursor protein (APP): lessons from different cellular models" Exp Gerontol (2000) 35: 843-850.

Konig et al., "Identification and differential expression of a novel alternative splice isoform of the beta A4 amyloid precursor protein (APP) mRNA in leukocytes and brain microglial cells" J Biol Chem (1992) 267: 1992.

Kumar et al., "Molecular cloning, expression, and regulation of hippocampal amyloid precursor protein of senescence accelerated mouse (SAMP8)" Biochem Cell Biol (2001) 79: 57-67.

Kumar et al., "Site-directed antisense oligonucleotide decreases the expression of amyloid precursor protein and reverses deficits in learning and memory in aged SAMP8 mice" Peptides (2000) 21: 1769-1775.

Le et al., "beta-Amyloid1-40 increases expression of beta-amyloid precursor protein in neuronal hybrid cells" J Neurochem (1995) 65: 2373-2376.

Le et al., "Beta-amyloid-induced neurotoxicity of a hybrid septal cell line associated with increased tau phosphorylation and expression of beta-amyloid precursor protein" J Neurochem (1997) 69: 978-985.

Leblanc et al., "Role of amyloid precursor protein (APP): study with antisense transfection of human neuroblastoma cells" J Neurosci Res (1992) 31: 635-645.

Li et al., "Polymorphic tetranucleotide repeat site within intron 7 of the beta-amyloid precursor protein gene and its lack of association with Alzheimer's disease" Hum Genet (1998) 103: 86-89.

Lima et al., "Single-stranded siRNAs activate RNAi in animals" Cell (2012) 150: 883-894.

Luo et al., "Characterization of the neurotrophic interaction between nerve growth factor and secreted alpha-amyloid precursor protein" J Neurosci Res (2001) 63: 410-420.

Luo et al., "Death of PC12 cells and hippocampal neurons induced by adenoviral-mediated FAD human amyloid precursor protein gene expression" J Neurosci Res (1999) 55: 629-642.

Magner et al., "Influence of mismatched and bulged nucleotides on SNP-preferential RNase H cleavage of RNA-antisense gapmer heteroduplexes" Sci Rep (2017) 7:12532 1-16.

Maher et al., "Comparative hybrid arrest by tandem antisense oligodeoxyribonucleotides or oligodeoxyribonucleoside methylphosphonates in a cell-free system" Nucl. Acid. Res. (1988) 16(8):3341-3358.

Majocha et al. "Modulation of the PC12 cell response to nerve growth factor by antisense oligonucleotide to amyloid precursor protein" Cell Mol NeuroBiol (1994) 14: 425-437.

Manczak et al., "RNA silencing of genes involved in Alzheimer's disease enhances mitochondrial function and synaptic activity" Biochim Biophys Acta (2013) 1832: 2368-2378.

Meng et al., "Amyloid beta protein precursor is involved in the growth of human colon carcinoma cell in vitro and in vivo" Int J Cancer (2001) 92: 31-39.

Miller et al., "Targeting Alzheimer's disease genes with RNA interference: an efficient strategy for silencing mutant alleles" Nucleic Acids Res (2004) 32: 661-668.

New England Biolabs 1998/1999 Catalog (cover page and pp. 121 and 284).

Nhan et al., "The multifaceted nature of amyloid precursor protein and its proteolytic fragments: friends and foes" Acta Neuropathol (2015) 129: 1-19.

Nykanen et al., "ATP requirements and small interfering RNA structure in the RNA interference pathway" Cell (2001) 107: 309-321.

Ohnishi et al., "Assessment of allele-specific gene silencing by RNA interference with mutant and wild-type reporter alleles" J RNAi Gene Silencing (2006) 2: 154-160.

Pietrzik et al., "From differentiation to proliferation: the secretory amyloid precursor protein as a local mediator of growth in thyroid epithelial cells" Proc Natl Acad Sci USA (1998) 95: 1770-1775.

Poon et al., "Antisense directed at the Abeta region of APP decreases brain oxidative markers in aged senescence accelerated mice" Brain Res. (2004) 1018: 86-96.

Poon et al., "Proteomic identification of less oxidized brain proteins in aged senescence-accelerated mice following administration of antisense oligonucleotide directed at the Abeta region of amyloid precursor protein" Brain Res Mol Brain Res (2005) 138: 8-16.

Reynolds et al., "Rational siRNA design for RNA interference" Nature Biotechnology (2004) 22(3):326-330.

Saitoh et al., "Secreted form of amyloid beta protein precursor is involved in the growth regulation of fibroblasts" Cell (1989) 58: 615-622.

Sandbrink et al., "APP gene family: unique age-associated changes in splicing of Alzheimer's betaA4-amyloid protein precursor" Neurobiol Dis (1994) 1: 13-24.

Sanghvi et al., "Heterocyclic Base Modifications in Nucleic Acids and Their Applications in Antisense Oligonucleotides" Antisense Research and Applications (1993) pp. 273-288.

Sawa et al., "APP-directed antisense oligonucleotides reduced APP gene expression in mouse models of Down Syndrome" Poster Presentation for Society of Neuroscience (2018) Nov. 3-7, 2018 San Diego, CA.

Sawa et al., "APP-directed antisense oligonucleotides reduced APP gene expression in mouse models of Down Syndrome" Abstract for Society of Neuroscience (2018) Nov. 3-7, 2018 San Diego, CA.

Seth et al., "Short Antisense Oligonucleotides with Novel 2'-4' Conformationaly Restricted Nucleoside Analogues Show Improved Potency Without Increased Toxicity in Animals." J Med Chem (2009) 52:10-13.

Sharp "RNA interference—2001" Genes Dev (2001) 15: 485-490.

Suh et al., "Molecular physiology, biochemistry, and pharmacology of Alzheimer's amyloid precursor protein (APP)" Ann NY Acad Sci (1996) 786: 169-183.

Woolf et al., "Specificity of antisense oligonucleotides in vivo" PNAS (1992) 89: 7305-7309.

Yoshikai et al., "Genomic organization of the human amyloid beta-protein precursor gene" Gene (1990) 87: 257-263.

Extended EP Search Report for 19760045.5 dated Feb. 28, 2022.

(56) References Cited

OTHER PUBLICATIONS

Nikiforov et al., "The use of phosphorothioate primers and exonuclease hydrolysis for the preparation of single-stranded PCR products and their detection by solid-phase hybridization" PCT Methods and Applications (1994) 3: 285-291.

Anderson et al., "Towards next generation antisense oligonucleotides: mesylphosphoramidate modification improves therapeutic index and duration of effect of gapmer antisense oligonucleotides" Nucl Acid Res (2021) 49: 9026-9041.

Monia et al., "Muclease Resistance and Antisense Activity of Modified Oligonucleotides Targeted to Ha-ras" J Biol Chem (1996) 271: 14533-14540.

Shyam et al., "Intraventricular Delivery of siRNA Nanoparticles to the Central Nervous System" Mol Ther Nucl Acids (2015) 4: e242.

Kurreck et al., "The Role of Backbone Modifications in Oligonucleotide-Based Strategies" Therapeutic Oligonucleotides, The Royal Society of Chemistry (2008) p. 1-22.

Chakravarthy et al., "Nucleic Acid-Based Theranostics for Tackling Alzheimer's Disease" Theranostics (2017) 7: 3933-3947.

Extended EP Search Report for 21849997.8 dated Jan. 27, 2025.

Partial EP Search Report for 21849997.8 dated Oct. 24, 2024.

International Search Report for PCT/US24/016102 dated Jul. 17, 2024.

Miroshnichenko et al., "Mesyl phosphoramidate antisense oligonucleotides as an alternative to phosphorothioates with improved biochemical and biological properties" PNAS (2019) 116: 1229-1234.

\* cited by examiner

COMPOUNDS AND METHODS FOR REDUCING APP EXPRESSION

SEQUENCE LISTING

The present application is being filed along with a Sequence Listing in electronic format. The Sequence Listing is provided as a file entitled BIOL0384USSEQ_ST25.txt, created on Jul. 14, 2021 which is 1007 KB in size. The information in the electronic format of the sequence listing is incorporated herein by reference in its entirety.

FIELD

Provided are compounds, methods, and pharmaceutical compositions for reducing the amount or activity of APP RNA in a cell or animal, and in certain instances reducing the amount of APP protein in a cell or animal. Certain such compounds, methods, and pharmaceutical compositions are useful to ameliorate at least one symptom or hallmark of a neurodegenerative disease or disorder. Such symptoms and hallmarks include cognitive impairment, including a decline in memory and language skills, behavioral and psychological symptoms such as apathy and lack of motivation, gait disturbances and seizures, progressive dementia, and abnormal amyloid deposits. Such neurodegenerative diseases and disorders include sporadic Alzheimer's Disease, genetic/familial Alzheimer's Disease, Alzheimer's Disease in Down Syndrome patients, and Cerebral Amyloid Angiopathy.

BACKGROUND

Alzheimer's Disease (AD), including both sporadic Alzheimer's Disease and genetic/familial Alzheimer's Disease, is the most common cause of age-associated dementia, affecting an estimated 5.7 million Americans a year (Alzheimer's Association. 2018 Alzheimer's Disease Facts and Figures. *Alzheimer's Dement.* 2018; 14(3):367-429). AD is characterized by the accumulation of β-amyloid plaques in the brain prior to the onset of overt clinical symptoms. Such overt clinical symptoms include cognitive impairment, including a decline in memory and language skills, behavioral and psychological symptoms such as apathy and lack of motivation, gait disturbances and seizures, and progressive dementia.

Patients with Down Syndrome (DS) can experience early-onset Alzheimer's disease (AD in DS), with amyloid plaque formation observed by age 40 in most DS patients, and Alzheimer's dementia observed by age 50 in more than 50% of Down Syndrome patients.

Cerebral Amyloid Angiopathy (CAA) is a related disease that is characterized by the deposition of β-amyloid in blood vessels of the CNS. CAA is often observed in AD patients upon autopsy, but is also associated with aging in the absence of clinical signs of AD.

AD, AD in DS, and CAA are all characterized by the abnormal accumulation of β-amyloid plaques. β-amyloid (Aβ) is derived from amyloid precursor protein (APP) upon processing of APP by α-, β-, and γ-secretases. In addition to the 42-amino acid fragment Aβ, a variety of other fragments of APP are also formed, several of which are proposed to contribute to the onset of dementia in AD (reviewed in Nhan, et al., "The multifaceted nature of amyloid precursor protein and its proteolytic fragments: friends and foes", *Acta Neuropath.*, 2015, 129(1): 1-19). The increased incidence of AD in DS patients is thought to be directly related to the increased copy number of the APP gene, which resides on chromosome 21.

Currently there is a lack of acceptable options for treating neurodegenerative diseases and disorders such as AD, AD in DS, and CAA. It is therefore an object herein to provide compounds, methods, and pharmaceutical compositions for the treatment of such diseases and disorders.

SUMMARY OF THE INVENTION

Provided herein are compounds, methods and pharmaceutical compositions for reducing the amount or activity of APP RNA, and in certain embodiments reducing the amount of APP protein in a cell or animal. In certain embodiments, the animal has a neurodegenerative disease or disorder. In certain embodiments, the animal has Alzheimer's Disease (AD). In certain embodiments, the animal has Alzheimer's Disease in conjunction with Down Syndrome (AD in DS). In certain embodiments, the animal has Cerebral Amyloid Angiopathy (CAA). In certain embodiments, compounds useful for reducing expression of APP RNA are oligomeric compounds. In certain embodiments, compounds useful for reducing expression of APP RNA are modified oligonucleotides.

Also provided are methods useful for ameliorating at least one symptom or hallmark of a neurodegenerative disease or disorder. In certain embodiments, the neurodegenerative disease is Alzheimer's Disease. In certain embodiments, the neurodegenerative disease is Alzheimer's Disease in Down Syndrome patients. In certain embodiments, the neurodegenerative disease is Cerebral Amyloid Angiopathy (CAA). In certain embodiments, the symptom or hallmark includes cognitive impairment, including a decline in memory and language skills, behavioral and psychological symptoms such as apathy and lack of motivation, gait disturbances and seizures, progressive dementia, or abnormal amyloid deposits.

DETAILED DESCRIPTION OF THE INVENTION

It is to be understood that both the foregoing general description and the following detailed description are exemplary and explanatory only and are not restrictive. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated-by-reference for the portions of the document discussed herein, as well as in their entirety.

Definitions

Unless specific definitions are provided, the nomenclature used in connection with, and the procedures and techniques of, analytical chemistry, synthetic organic chemistry, and medicinal and pharmaceutical chemistry described herein are those well-known and commonly used in the art. Where permitted, all patents, applications, published applications and other publications and other data referred to throughout in the disclosure are incorporated by reference herein in their entirety.

Unless otherwise indicated, the following terms have the following meanings:

Definitions

As used herein, "2'-deoxynucleoside" means a nucleoside comprising a 2'-H(H) deoxyribosyl sugar moiety. In certain embodiments, a 2'-deoxynucleoside is a 2'-β-D-deoxynucleoside and comprises a 2'-β-D-deoxyribosyl sugar moiety, which has the β-D configuration as found in naturally occurring deoxyribonucleic acids (DNA). In certain embodiments, a 2'-deoxynucleoside or a nucleoside comprising an unmodified 2'-deoxyribosyl sugar moiety may comprise a modified nucleobase or may comprise an RNA nucleobase (uracil).

As used herein, "2'-substituted nucleoside" means a nucleoside comprising a 2'-substituted sugar moiety. As used herein, "2'-substituted" in reference to a sugar moiety means a sugar moiety comprising at least one 2'-substituent group other than H or OH.

As used herein, "2'-MOE" means a 2'-OCH$_2$CH$_2$OCH$_3$ group in place of the 2'-OH group of a ribosyl sugar moiety. A "2'-MOE sugar moiety" is a sugar moiety with a 2'-OCH$_2$CH$_2$OCH$_3$ group in place of the 2'-OH group of a ribosyl sugar moiety. Unless otherwise indicated, a 2'-MOE sugar moiety is in the β-D configuration. "MOE" means O-methoxyethyl.

As used herein, "2'-MOE nucleoside" means a nucleoside comprising a 2'-MOE sugar moiety.

As used herein, "2'-OMe" or "2'-O-methyl sugar moiety" means a 2'-OCH$_3$ group in place of the 2'-OH group of a ribosyl sugar moiety. Unless otherwise indicated, a 2'-OMe has the β-D stereochemical configuration.

As used herein, "2'-OMe nucleoside" means a nucleoside comprising a 2'-OMe sugar moiety.

As used herein, "3' target site" refers to the 3'-most nucleotide of a target nucleic acid which is complementary to an antisense oligonucleotide, when the antisense oligonucleotide is hybridized to the target nucleic acid.

As used herein, "5' target site" refers to the 5'-most nucleotide of a target nucleic acid which is complementary to an antisense oligonucleotide, when the antisense oligonucleotide is hybridized to the target nucleic acid.

As used herein, "5-methyl cytosine" means a cytosine modified with a methyl group attached to the 5 position. A 5-methyl cytosine is a modified nucleobase.

As used herein, "abasic sugar moiety" means a sugar moiety of a nucleoside that is not attached to a nucleobase. Such abasic sugar moieties are sometimes referred to in the art as "abasic nucleosides."

As used herein, "administration" or "administering" means providing a pharmaceutical agent or composition to an animal.

As used herein, "animal" means a human or non-human animal.

As used herein, "antisense activity" means any detectable and/or measurable change attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound.

As used herein, "antisense compound" means an oligomeric compound capable of achieving at least one antisense activity.

As used herein, "antisense oligonucleotide" means an oligonucleotide, including the oligonucleotide portion of an oligomeric compound that is complementary to a target nucleic acid and is capable of achieving at least one antisense activity. Antisense oligonucleotides include but are not limited to antisense RNase H oligonucleotides.

As used herein, "ameliorate" in reference to a treatment means improvement in at least one symptom relative to the same symptom in the absence of the treatment. In certain embodiments, amelioration is the reduction in the severity or frequency of a symptom or the delayed onset or slowing of progression in the severity or frequency of a symptom. In certain embodiments, the symptom or hallmark is cognitive impairment, including a decline in memory and language skills, behavioral and psychological symptoms such as apathy and lack of motivation, gait disturbances and seizures, progressive dementia, or abnormal amyloid deposits.

As used herein, "bicyclic nucleoside" or "BNA" means a nucleoside comprising a bicyclic sugar moiety.

As used herein, "bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the bicyclic sugar moiety does not comprise a furanosyl moiety.

As used herein, "cleavable moiety" means a bond or group of atoms that is cleaved under physiological conditions, for example, inside a cell, an animal, or a human.

As used herein, "complementary" in reference to an oligonucleotide means that at least 70% of the nucleobases of the oligonucleotide or one or more regions thereof and the nucleobases of another nucleic acid or one or more regions thereof are capable of hydrogen bonding with one another when the nucleobase sequence of the oligonucleotide and the other nucleic acid are aligned in opposing directions. Complementary nucleobases means nucleobases that are capable of forming hydrogen bonds with one another. Complementary nucleobase pairs include adenine (A) and thymine (T), adenine (A) and uracil (U), cytosine (C) and guanine (G), 5-methyl cytosine (mC) and guanine (G). Certain modified nucleobases that pair with natural nucleobases or with other modified nucleobases are known in the art. For example, inosine can pair with adenosine, cytosine, or uracil. Complementary oligonucleotides and/or nucleic acids need not have nucleobase complementarity at each nucleoside. Rather, some mismatches are tolerated. As used herein, "fully complementary" or "100% complementary" in reference to oligonucleotides means that oligonucleotides are complementary to another oligonucleotide or nucleic acid at each nucleoside of the oligonucleotide.

As used herein, "conjugate group" means a group of atoms that is directly attached to an oligonucleotide. Conjugate groups include a conjugate moiety and a conjugate linker that attaches the conjugate moiety to the oligonucleotide.

As used herein, "conjugate linker" means a single bond or a group of atoms comprising at least one bond that connects a conjugate moiety to an oligonucleotide.

As used herein, "conjugate moiety" means a group of atoms that is attached to an oligonucleotide via a conjugate linker.

As used herein, "contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

As used herein, "constrained ethyl" or "cEt" or "cEt modified sugar moiety" means a β-D ribosyl bicyclic sugar moiety wherein the second ring of the bicyclic sugar is formed via a bridge connecting the 4'-carbon and the 2'-carbon of the β-D ribosyl sugar moiety, wherein the bridge has the formula 4'-CH(CH$_3$)—O-2', and wherein the methyl group of the bridge is in the S configuration.

As used herein, "cEt nucleoside" means a nucleoside comprising a cEt modified sugar moiety.

As used herein, "chirally enriched population" means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more stereorandom chiral centers. In certain embodiments, the molecules are modified oligonucleotides. In certain embodiments, the molecules are oligomeric compounds comprising modified oligonucleotides.

As used herein, "double-stranded" means a duplex formed by complementary strands of nucleic acids (including, but not limited to oligonucleotides) hybridized to one another. In certain embodiments, the two strands of a double-stranded region are separate molecules. In certain embodiments, the two strands are regions of the same molecule that has folded onto itself (e.g., a hairpin structure).

As used herein, "duplex" or "duplex region" means the structure formed by two oligonucleotides or portions thereof that are hybridized to one another.

As used herein, "gapmer" means a modified oligonucleotide comprising an internal region having a plurality of nucleosides that support RNase H cleavage positioned between external regions having one or more nucleosides, wherein at least one of the nucleosides comprising the internal region is chemically distinct from at least one nucleoside of each of the external regions. Specifically, the nucleosides that define the boundaries of the internal region and each external region must be chemically distinct. The internal region may be referred to as the "gap" and the external regions may be referred to as the "wings." Unless otherwise indicated, "gapmer" refers to a sugar motif. In certain embodiments, the sugar moiety of each nucleoside of the gap is a 2'-β-D-deoxyribosyl sugar moiety. In certain embodiments, the gap comprises one 2'-substituted nucleoside at position 1, 2, 3, 4, or 5 of the gap, and the remainder of the nucleosides of the gap are 2'-β-D-deoxynucleosides. Unless otherwise indicated, a gapmer may comprise one or more modified internucleoside linkages and/or modified nucleobases and such modifications do not necessarily follow the gapmer pattern of the sugar modifications.

As used herein, "hotspot region" is a range of nucleobases on a target nucleic acid that is amenable to oligomeric compound-mediated reduction of the amount or activity of the target nucleic acid.

As used herein, "hybridization" means the pairing or annealing of complementary oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases.

As used herein, "internucleoside linkage" is the covalent linkage between adjacent nucleosides in an oligonucleotide. As used herein "modified internucleoside linkage" means any internucleoside linkage other than a phosphodiester internucleoside linkage. "Phosphorothioate internucleoside linkage" is a modified internucleoside linkage in which one of the non-bridging oxygen atoms of a phosphodiester internucleoside linkage is replaced with a sulfur atom.

As used herein, "linker-nucleoside" means a nucleoside that links, either directly or indirectly, an oligonucleotide to a conjugate moiety. Linker-nucleosides are located within the conjugate linker of an oligomeric compound. Linker-nucleosides are not considered part of the oligonucleotide portion of an oligomeric compound even if they are contiguous with the oligonucleotide.

As used herein, "non-bicyclic modified sugar moiety" means a modified sugar moiety that comprises a modification, such as a substituent, that does not form a bridge between two atoms of the sugar to form a second ring.

As used herein, "mismatch" or "non-complementary" means a nucleobase of a first nucleic acid sequence that is not complementary with the corresponding nucleobase of a second nucleic acid sequence or target nucleic acid when the first and second nucleic acid sequences are aligned.

As used herein, "motif" means the pattern of unmodified and/or modified sugar moieties, nucleobases, and/or internucleoside linkages, in an oligonucleotide.

As used herein, "neurodegenerative disease" or "neurodegenerative disorder" means a condition marked by progressive loss of function or structure, including loss of neuronal function and death of neurons. In certain embodiments, the neurodegenerative disease is Alzheimer's Disease. In certain embodiments, the neurodegenerative disease is sporadic Alzheimer's Disease. In certain embodiments, the neurodegenerative disease is genetic/familial Alzheimer's Disease. In certain embodiments, the neurodegenerative disease is Alzheimer's Disease in Down Syndrome patients. In certain embodiments, the neurodegenerative disease is Cerebral Amyloid Angiopathy.

As used herein, "nucleobase" means an unmodified nucleobase or a modified nucleobase. A nucleobase is a heterocyclic moiety. As used herein an "unmodified nucleobase" is adenine (A), thymine (T), cytosine (C), uracil (U), or guanine (G). As used herein, a "modified nucleobase" is a group of atoms other than unmodified A, T, C, U, or G capable of pairing with at least one other nucleobase. A "5-methyl cytosine" is a modified nucleobase. A universal base is a modified nucleobase that can pair with any one of the five unmodified nucleobases.

As used herein, "nucleobase sequence" means the order of contiguous nucleobases in a nucleic acid or oligonucleotide independent of any sugar or internucleoside linkage modification.

As used herein, "nucleoside" means a compound or fragment of a compound comprising a nucleobase and a sugar moiety. The nucleobase and sugar moiety are each, independently, unmodified or modified.

As used herein, "modified nucleoside" means a nucleoside comprising a modified nucleobase and/or a modified sugar moiety.

As used herein, "linked nucleosides" are nucleosides that are connected in a contiguous sequence (i.e., no additional nucleosides are presented between those that are linked).

As used herein, "oligomeric compound" means an oligonucleotide and optionally one or more additional features, such as a conjugate group or terminal group. An oligomeric compound may be paired with a second oligomeric compound that is complementary to the first oligomeric compound or may be unpaired. A "singled-stranded oligomeric compound" is an unpaired oligomeric compound. The term "oligomeric duplex" means a duplex formed by two oligomeric compounds having complementary nucleobase sequences. Each oligomeric compound of an oligomeric duplex may be referred to as a "duplexed oligomeric compound."

As used herein, "oligonucleotide" means a polymer or strand of linked nucleosides connected via internucleoside linkages, wherein each nucleoside and internucleoside linkage may be modified or unmodified. Unless otherwise indicated, oligonucleotides consist of 8-50 linked nucleosides. An oligonucleotide may be paired with a second oligonucleotide that is complementary to the oligonucleotide or it may be unpaired. A "single-stranded oligonucleotide" is an unpaired oligonucleotide. A "double-stranded oligonucleotide" is an oligonucleotide that is paired with a second oligonucleotide. An "oligonucleotide duplex" means a duplex formed by two paired oligonucleotides having complementary nucleobase sequences. Each oligo of an oligonucleotide duplex is a "duplexed oligonucleotide" or a "double-stranded oligonucleotide".

As used herein, "modified oligonucleotide" means an oligonucleotide, wherein at least one nucleoside or internucleoside linkage is modified. As used herein, "unmodified oligonucleotide" means an oligonucleotide that does not comprise any nucleoside modifications or internucleoside modifications. Thus, each nucleoside of an unmodified oligonucleotide is a DNA or RNA nucleoside and each internucleoside linkage is a phosphodiester linkage.

As used herein, "pharmaceutically acceptable carrier or diluent" means any substance suitable for use in administering to an animal. Certain such carriers enable pharmaceutical compositions to be formulated as, for example, tablets, pills, dragees, capsules, liquids, gels, syrups, slurries, suspension and lozenges for the oral ingestion by a subject. In certain embodiments, a pharmaceutically acceptable carrier or diluent is sterile water, sterile saline, sterile buffer solution or sterile artificial cerebrospinal fluid.

As used herein "pharmaceutically acceptable salts" means physiologically and pharmaceutically acceptable salts of compounds. Pharmaceutically acceptable salts retain the desired biological activity of the parent compound and do not impart undesired toxicological effects thereto.

As used herein "pharmaceutical composition" means a mixture of substances suitable for administering to a subject. For example, a pharmaceutical composition may comprise an oligomeric compound and a sterile aqueous solution. In certain embodiments, a pharmaceutical composition shows activity in free uptake assay in certain cell lines.

As used herein "prodrug" means a therapeutic agent in a first form outside the body that is converted to a second form within an animal or cells thereof. Typically, conversion of a prodrug within the animal is facilitated by the action of an enzymes (e.g., endogenous or viral enzyme) or chemicals present in cells or tissues and/or by physiologic conditions. In certain embodiments, the first form of the prodrug is less active than the second form.

As used herein, "reducing or inhibiting the amount or activity" refers to a reduction or blockade of the transcriptional expression or activity relative to the transcriptional expression or activity in an untreated or control sample and does not necessarily indicate a total elimination of transcriptional expression or activity.

As used herein, "RNase H compound" means an antisense compound that acts, at least in part, through RNase H to modulate a target nucleic acid and/or protein encoded by a target nucleic acid. In certain embodiments, RNase H compounds are single-stranded. In certain embodiments, RNase H compounds are double-stranded. RNase H compounds may comprise conjugate groups and/or terminal groups. In certain embodiments, an RNase H compound modulates the amount or activity of a target nucleic acid. The term RNase H compound excludes antisense compounds that act principally through RISC/Ago2.

As used herein, "antisense RNase H oligonucleotide" means an oligonucleotide comprising a region that is complementary to a target sequence, and which includes at least one chemical modification suitable for RNase H-mediated nucleic acid reduction.

As used herein, "RNAi agent" means an antisense compound that acts, at least in part, through RISC or Ago2 to modulate a target nucleic acid and/or protein encoded by a target nucleic acid. RNAi agents include, but are not limited to double-stranded siRNA, single-stranded RNA (ssRNA), and microRNA, including microRNA mimics. RNAi agents may comprise conjugate groups and/or terminal groups. In certain embodiments, an RNAi agent modulates the amount and/or activity of a target nucleic acid. The term RNAi agent excludes antisense compounds that act through RNase H.

As used herein, "RNAi oligonucleotide" means an antisense RNAi oligonucleotide or a sense RNAi oligonucleotide.

As used herein, "antisense RNAi oligonucleotide" means an oligonucleotide comprising a region that is complementary to a target sequence, and which includes at least one chemical modification suitable for RNAi.

As used herein, "sense RNAi oligonucleotide" means an oligonucleotide comprising a region that is complementary to a region of an antisense RNAi oligonucleotide, and which is capable of forming a duplex with such antisense RNAi oligonucleotide. A duplex formed by an antisense RNAi oligonucleotide and a sense RNAi oligonucleotide is referred to as a double-stranded RNAi agent (dsRNAi) or a short interfering RNA (siRNA).

As used herein, "self-complementary" in reference to an oligonucleotide means an oligonucleotide that at least partially hybridizes to itself.

As used herein, "single-stranded" means a nucleic acid (including but not limited to an oligonucleotide) that is unpaired and is not part of a duplex. Single-stranded compounds are capable of hybridizing with complementary nucleic acids to form duplexes, at which point they are no longer single-stranded.

As used herein, "stabilized phosphate group" means a 5'-phosphate analog that is metabolically more stable than a 5'-phosphate as naturally occurs on DNA or RNA.

As used herein, "standard cell assay" means the assay described in Examples 1-3 or 5 and reasonable variations thereof.

As used herein, "stereorandom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the result of a synthetic method that is not designed to control the stereochemical configuration. In certain embodiments, a stereorandom chiral center is a stereorandom phosphorothioate internucleoside linkage.

As used herein, "subject" means a human or non-human animal. The terms "subject" and "individual" are used interchangeably. In certain embodiments, the subject is human.

As used herein, "sugar moiety" means an unmodified sugar moiety or a modified sugar moiety. As used herein, "unmodified sugar moiety" means a 2'-OH(H) ribosyl moiety, as found in RNA (an "unmodified RNA sugar moiety"), or a 2'-H(H) deoxyribosyl sugar moiety, as found in DNA (an "unmodified DNA sugar moiety"). Unmodified sugar moieties have one hydrogen at each of the 1', 3', and 4' positions, an oxygen at the 3' position, and two hydrogens at the 5' position. As used herein, "modified sugar moiety" or "modified sugar" means a modified furanosyl sugar moiety or a sugar surrogate.

As used herein, "sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary oligomeric compounds or target nucleic acids.

As used herein, "symptom or hallmark" means any physical feature or test result that indicates the existence or extent of a disease or disorder. In certain embodiments, a symptom is apparent to a subject or to a medical professional examining or testing said subject. In certain embodiments, a hallmark is apparent upon invasive diagnostic testing, including, but not limited to, post-mortem tests.

As used herein, "target nucleic acid" and "target RNA" mean a nucleic acid that an antisense compound is designed to affect. Target RNA means an RNA transcript and includes pre-mRNA and mRNA unless otherwise specified.

As used herein, "target region" means a portion of a target nucleic acid to which an oligomeric compound is designed to hybridize.

As used herein, "terminal group" means a chemical group or group of atoms that is covalently linked to a terminus of an oligonucleotide.

As used herein, "therapeutically effective amount" means an amount of a pharmaceutical agent or composition that provides a therapeutic benefit to an animal. For example, a therapeutically effective amount improves a symptom of a disease or disorder.

As used herein, "treating" means improving a subject's disease or disorder by administering an oligomeric agent or oligomeric compound described herein. In certain embodiments, treating a subject improves a symptom relative to the same symptom in the absence of the treatment. In certain embodiments, treatment reduces in the severity or frequency of a symptom, or delays the onset of a symptom, slows the progression of a symptom, or slows the severity or frequency of a symptom.

Certain Embodiments

The present disclosure provides the following non-limiting numbered embodiments:

Embodiment 1. An oligomeric compound comprising a modified oligonucleotide consisting of 12 to 30 linked nucleosides wherein the nucleobase sequence of the modified oligonucleotide is at least 80% complementary to an equal length portion of an APP nucleic acid, and wherein the modified oligonucleotide comprises at least one modification selected from a modified sugar moiety and a modified internucleoside linkage.

Embodiment 2. An oligomeric compound comprising a modified oligonucleotide consisting of 12 to 30 linked nucleosides, wherein the nucleobase sequence of the modified oligonucleotide comprises at least 12, at least 13, at least 14, least 15, or 16 contiguous nucleobases of any of the nucleobase sequences of SEQ ID NOS: 2543-2572; wherein the modified oligonucleotide comprises at least one modification selected from a modified sugar moiety and a modified internucleoside linkage.

Embodiment 3. An oligomeric compound comprising a modified oligonucleotide consisting of 12 to 30 linked nucleosides, wherein the nucleobase sequence of the modified oligonucleotide comprises at least 12, at least 13, at least 14, at least 15, at least 16, at least 17, at least 18, at least 19, or 20 contiguous nucleobases of any of the nucleobase sequences of SEQ ID NOS: 30-2542 or 2573-3057; wherein the modified oligonucleotide comprises at least one modification selected from a modified sugar moiety and a modified internucleoside linkage.

Embodiment 4. An oligomeric compound comprising a modified oligonucleotide consisting of 12 to 30 linked nucleosides wherein the nucleobase sequence of the modified oligonucleotide is complementary to at least 8, at least 9, at least 10, at least 11, at least 12, at least 13, at least 14, at least 15, at least 16, at least 17, at least 18, at least 19, or at least 20 contiguous nucleobases of:
  an equal length portion of nucleobases 6193-6245 of SEQ ID NO: 2;
  an equal length portion of nucleobases 9656-9656 of SEQ ID NO: 2;
  an equal length portion of nucleobases 10203-10249 of SEQ ID NO: 2;
  an equal length portion of nucleobases 11246-11287 of SEQ ID NO: 2;
  an equal length portion of nucleobases 12566-12609 of SEQ ID NO: 2;
  an equal length portion of nucleobases 22914-22964 of SEQ ID NO: 2;
  an equal length portion of nucleobases 154394-154420 of SEQ ID NO: 2;
  an equal length portion of nucleobases 154736-154760 of SEQ ID NO: 2;
  an equal length portion of nucleobases 158598-158982 of SEQ ID NO: 2;
  an equal length portion of nucleobases 159558-159581 of SEQ ID NO: 2;
  an equal length portion of nucleobases 220028-220077 of SEQ ID NO: 2;

an equal length portion of nucleobases 220237-220426 of SEQ ID NO: 2;
an equal length portion of nucleobases 220710-220766 of SEQ ID NO: 2;
an equal length portion of nucleobases 220893-220919 of SEQ ID NO: 2;
an equal length portion of nucleobases 221002-221025 of SEQ ID NO: 2;
an equal length portion of nucleobases 221138-221177 of SEQ ID NO: 2;
an equal length portion of nucleobases 221315-221364 of SEQ ID NO: 2;
an equal length portion of nucleobases 222414-222478 of SEQ ID NO: 2;
an equal length portion of nucleobases 222548-222590 of SEQ ID NO: 2;
an equal length portion of nucleobases 222663-222697 of SEQ ID NO: 2;
an equal length portion of nucleobases 222764-222791 of SEQ ID NO: 2;
an equal length portion of nucleobases 225366-225400 of SEQ ID NO: 2;
an equal length portion of nucleobases 226497-226532 of SEQ ID NO: 2;
an equal length portion of nucleobases 229282-229306 of SEQ ID NO: 2;
an equal length portion of nucleobases 231282-231310 of SEQ ID NO: 2;
an equal length portion of nucleobases 234328-234370 of SEQ ID NO: 2;
an equal length portion of nucleobases 234802-234827 of SEQ ID NO: 2;
an equal length portion of nucleobases 34556-34575 of SEQ ID NO: 2;
an equal length portion of nucleobases 101718-101737 of SEQ ID NO: 2;
an equal length portion of nucleobases 158795-158814 of SEQ ID NO: 2; or
an equal length portion of nucleobases 292896-292922 of SEQ ID NO: 2;
wherein the modified oligonucleotide comprises at least one modification selected from a modified sugar moiety and a modified internucleoside linkage.

Embodiment 5. An oligomeric compound comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or 20 contiguous nucleobases of a sequence selected from:
SEQ ID NOs: 140, 1240, 1279, 1402, 1437;
SEQ ID NOs: 116, 202, 626;
SEQ ID NOs: 830, 912, 962, 1049, 1164, 1236;
SEQ ID NOs: 201, 1741, 1870;
SEQ ID NOs: 273, 744, 824, 898, 1025;
SEQ ID NOs: 296, 384, 1568, 1617, 1701, 1734, 1841;
SEQ ID NOs: 1553, 1593, 1709, 1805, 1873;
SEQ ID NOs: 340, 519, 590, 711, 795, 819;
SEQ ID NOs: 178, 547, 577, 693, 769, 846, 2225, 2480, 3047-3050;
SEQ ID NOs: 200, 1688, 1740, 1820, 1906;
SEQ ID NOs: 2576, 2493, 2660, 2708, 2790, 2806, 2854, 2900, 2903, 2993, 3013;
SEQ ID NOs: 2590, 2690, 2691, 2760, 2808, 2939, 3002;
SEQ ID NOs: 2580, 2652, 2728, 2772, 2866, 2874, 2931, 3012;
SEQ ID NOs: 2619, 2671, 2783, 2812, 2875, 2929;
SEQ ID NOs: 2638, 2649, 2676, 2753, 2757, 2804, 2932, 2983;
SEQ ID NOs: 2575, 2848, 2890, 2965;
SEQ ID NOs: 2583, 2654, 2748, 2823, 2882;
SEQ ID NOs: 1557, 1613, 1696, 2592, 2699, 2713, 2775, 2844, 2879, 2977, 2986;
SEQ ID NOs: 338, 2574, 2642, 2666, 2689, 2740, 2754, 2847, 2859, 2899, 2950, 2987, 3014;
SEQ ID NOs: 2641, 2675, 2799, 2856, 2933, 2974;
SEQ ID NOs: 2610, 2780, 2851, 2943, 2956;
SEQ ID NOs: 2766, 2855, 2925, 2988;
SEQ ID NOs: 2645, 2715, 2727, 2787, 2842, 2843, 2938, 2940, 2967, 2978;
SEQ ID NOs: 299, 2632, 3020;
SEQ ID NOs: 2591, 2705, 2747, 2865, 2941, 3010;
SEQ ID NOs: 2621, 2629, 2679, 2687, 2735, 2788, 2864, 2912, 2966;
SEQ ID NOs: 2701, 2742, 2828, 2908;
SEQ ID NOs: 2611, 2717, 2979; or
SEQ ID NOs: 35,411,482,
wherein the modified oligonucleotide comprises at least one modification selected from a modified sugar moiety and a modified internucleoside linkage.

Embodiment 6. The oligomeric compound of any of embodiments 1-5, wherein the modified oligonucleotide has a nucleobase sequence that is at least 80%, at least 85%, at least 90%, at least 95%, or 100% complementary to any of the nucleobase sequences of SEQ ID NO: 1-8 when measured across the entire nucleobase sequence of the modified oligonucleotide.

Embodiment 7. The oligomeric compound of any of embodiments 1-6, wherein at least one nucleoside of the modified oligonucleotide is a modified nucleoside.

Embodiment 8. The oligomeric compound of embodiment 7, wherein the modified oligonucleotide comprises at least one modified nucleoside comprising a modified sugar moiety.

Embodiment 9. The oligomeric compound of embodiment 8, wherein the modified oligonucleotide comprises at least one modified nucleoside comprising a bicyclic modified sugar moiety.

Embodiment 10. The oligomeric compound of embodiment 9, wherein the bicyclic modified sugar moiety comprises a 2'-4' bridge, wherein the 2'-4' bridge is selected from —O—CH$_2$— and —O—CH(CH$_3$)—.

Embodiment 11. The oligomeric compound of any of embodiments 6-10, wherein the modified oligonucleotide comprises at least one modified nucleoside comprising a non-bicyclic modified sugar moiety.

Embodiment 12. The oligomeric compound of embodiment 8, wherein the modified oligonucleotide comprises at least one modified nucleoside comprising a bicyclic modified sugar moiety having a 2'-4' bridge and at least one modified nucleoside comprising a non-bicyclic modified sugar moiety.

Embodiment 13. The oligomeric compound of embodiment 11 or 12, wherein the non-bicyclic modified sugar moiety is a 2'-MOE sugar moiety or a 2'-OMe sugar moiety.

Embodiment 14. The oligomeric compound of any of embodiments 1-13, wherein the modified oligonucleotide comprises at least one modified nucleoside comprising a sugar surrogate.

Embodiment 15. The oligomeric compound of embodiment 14, wherein at least one modified nucleoside of the modified oligonucleotide comprises a sugar surrogate selected from morpholino and PNA.

Embodiment 16. The oligomeric compound of any of embodiments 1-8, 11, or 13-15, wherein the modified oligonucleotide does not comprise a bicyclic sugar moiety.

Embodiment 17. The oligomeric compound of any of embodiments 1-16, wherein the modified oligonucleotide comprises at least one modified internucleoside linkage.

Embodiment 18. The oligomeric compound of embodiment 17, wherein each internucleoside linkage of the modified oligonucleotide is a modified internucleoside linkage.

Embodiment 19. The oligomeric compound of embodiment 17 or embodiment 18, wherein at least one internucleoside linkage is a phosphorothioate internucleoside linkage.

Embodiment 20. The oligomeric compound of embodiment 16 or 17, wherein at least one internucleoside linkage is a mesyl phosphoramidate internucleoside linkage.

Embodiment 21. The oligomeric compound of embodiment 17 or 19-20, wherein the modified oligonucleotide comprises at least one phosphodiester internucleoside linkage.

Embodiment 22. The oligomeric compound of any of embodiments 17, 19, or 21, wherein each internucleoside linkage is independently selected from a phosphodiester internucleoside linkage or a phosphorothioate internucleoside linkage.

Embodiment 23. The oligomeric compound of any of embodiments 17, 19, or 20-21, wherein each internucleoside linkage is independently selected from a phosphodiester internucleoside linkage, a phosphorothioate internucleoside linkage, and a mesyl phosphoramidate internucleoside linkage.

Embodiment 24. The oligomeric compound of any of embodiments 1-17 or 19-21, or 23, wherein at least 1, at least 2, at least 3, at least 4, or at least 5 internucleoside linkages of the modified oligonucleotide are mesyl phosphoramidate internucleoside linkages.

Embodiment 25. The oligomeric compound of any of embodiments 1-24, wherein the modified oligonucleotide comprises a modified nucleobase.

Embodiment 26. The oligomeric compound of embodiment 25, wherein the modified nucleobase is a 5-methyl cytosine.

Embodiment 27. The oligomeric compound of any of embodiments 1-26 wherein the modified oligonucleotide consists of 12-22, 12-20, 14-18, 14-20, 15-17, 15-25, 16-20, 16-18, or 18-20 linked nucleosides.

Embodiment 28. The oligomeric compound of any of embodiments 1-27, wherein the modified oligonucleotide consists of 16 linked nucleosides.

Embodiment 29. The oligomeric compound of any of embodiments 1-27, wherein the modified oligonucleotide consists of 20 linked nucleosides.

Embodiment 30. The oligomeric compound of any of embodiments 1-29, wherein the modified oligonucleotide is a gapmer.

Embodiment 31. The oligomeric compound of any of embodiments 1-29, wherein the modified oligonucleotide has a sugar motif comprising:
a 5'-region consisting of 1-6 linked 5'-region nucleosides;
a central region consisting of 6-10 linked central region nucleosides; and a 3'-region consisting of 1-6 linked 3'-region nucleosides;

wherein the 3'-most nucleoside of the 5'-region and the 5'-most nucleoside of the 3'-region comprise modified sugar moieties, and
each of the central region nucleosides is selected from a nucleoside comprising a 2'-β-D-deoxyribosyl sugar moiety and a nucleoside comprising a 2'-substituted sugar moiety, wherein the central region comprises at least six nucleosides comprising a 2'-β-D-deoxyribosyl sugar moiety and no more than two nucleosides comprise a 2'-substituted sugar moiety.

Embodiment 32. The oligomeric compound of embodiment 29, wherein each of the central region nucleosides is a 2'-β-D-deoxynucleoside.

Embodiment 33. The oligomeric compound of embodiment 30 or embodiment 31, wherein the modified oligonucleotide has a sugar motif comprising:
a 5'-region consisting of 6 linked 5'-region nucleosides;
a central region consisting of 10 linked central region nucleosides; and
a 3'-region consisting of 4 linked 3'-region nucleosides; wherein
each of the 5'-region nucleosides and each of the 3'-region nucleosides is a 2'-MOE nucleoside, and
each of the central region nucleosides is a 2'-β-D-deoxynucleoside.

Embodiment 34. The oligomeric compound of embodiment 30 or embodiment 31, wherein the modified oligonucleotide has a sugar motif comprising:
a 5'-region consisting of 5 linked 5'-region nucleosides;
a central region consisting of 10 linked central region nucleosides; and
a 3'-region consisting of 5 linked 3'-region nucleosides; wherein
each of the 5'-region nucleosides and each of the 3'-region nucleosides is a 2'-MOE nucleoside, and
each of the central region nucleosides is a 2'-β-D-deoxynucleoside.

Embodiment 35. The oligomeric compound of embodiment 30 or embodiment 31, wherein the modified oligonucleotide has a sugar motif comprising:
a 5'-region consisting of 3 linked 5'-region nucleosides;
a central region consisting of 10 linked central region nucleosides; and
a 3'-region consisting of 3 linked 3'-region nucleosides; wherein
each of the 5'-region nucleosides and each of the 3'-region nucleosides is a cEt nucleoside, and each of the central region nucleosides is a 2'-β-D-deoxynucleoside.

Embodiment 36. The oligomeric compound of embodiment 30, wherein the modified oligonucleotide has a sugar motif comprising:
a 5'-region consisting of 3 linked 5'-region nucleosides;
a central region consisting of 10 linked central region nucleosides; and
a 3'-region consisting of 3 linked 3'-region nucleosides; wherein
each of the 5'-region nucleosides and each of the 3'-region nucleosides is a cEt nucleoside,
and the central region has the following formula: (Nd)(Nx)(Nd)n, wherein Nx is a 2'-OMe nucleoside and each Nd is a 2'-β-D-deoxynucleoside, and n is 8.

Embodiment 37. The oligomeric compound of any of embodiments 1-36, wherein the modified oligonucleotide has an internucleoside linkage motif selected from: soosssssssssssos, sooooosssssssssssoss, sooosssssssssssooss, sooooosssssssssssoss, sooosssssssssssooos or ssoosssssssssssooss, wherein s=a phosphorothioate internucleoside linkage and o=a phosphodiester internucleoside linkage.

Embodiment 38. The oligomeric compound of any of embodiments 1-36, wherein the modified oligonucleotide has an internucleoside linkage motif selected from soozzssssssssos, soozzzssssssos, soozzzzsssss-sos, soozzzzzsssssos, zoozzzzzssssssoz, soossssssszzsos, soossssssszzos, soossssssszzs, sooooozzssssssssoss, sooooozzzssssssoss, sooooozzzzsssssoss, sooooozzzzzssssoss, zooooozzzzssssssozz, sooooossssssszzsoss, sooooossssssszzoss, sooooosssssssszzss, sooo-szzsssssssooss, soooszzzssssssooss, soooszzzzsssss-sooss, soooszzzzzsssssooss, zoooszzzzzssssssoozz, sooosssssssszzsooss, sooossssssssszzooss, and soooossssssssszzoss, wherein s=a phosphorothioate internucleoside linkage, o=a phosphodiester internucleoside linkage, and z=a mesyl phosphoramidate internucleoside linkage.

Embodiment 39. The oligomeric compound of any of embodiments 1-38, consisting of the modified oligonucleotide.

Embodiment 40. The oligomeric compound of any of embodiments 1-38, further comprising a conjugate group.

Embodiment 41. The oligomeric compound of embodiment 40, wherein the conjugate group comprises a conjugate moiety and a conjugate linker.

Embodiment 42. The oligomeric compound of embodiment 41, wherein the conjugate linker consists of a single bond.

Embodiment 43. The oligomeric compound of embodiment 41 or embodiment 42, wherein the conjugate linker is cleavable.

Embodiment 44. The oligomeric compound of embodiment 41, wherein the conjugate linker comprises 1-3 linker-nucleosides.

Embodiment 45. The oligomeric compound of any of embodiments 40-44, wherein the conjugate group is attached to the modified oligonucleotide at the 5'-end of the modified oligonucleotide.

Embodiment 46. The oligomeric compound of any of embodiments 40-44, wherein the conjugate group is attached to the modified oligonucleotide at the 3'-end of the modified oligonucleotide.

Embodiment 47. The oligomeric compound of any of embodiments 1-38 or 40-45, comprising a terminal group.

Embodiment 48. The oligomeric compound of any of embodiments 1-47 wherein the oligomeric compound is a singled-stranded oligomeric compound.

Embodiment 49. The oligomeric compound of any of embodiments 1-43 or 45-48, wherein the oligomeric compound does not comprise linker-nucleosides.

Embodiment 50. An oligomeric duplex comprising an oligomeric compound of any of embodiments 1-47 or 49.

Embodiment 51. An oligomeric compound comprising a modified oligonucleotide consisting of 12 to 30 linked nucleosides, wherein the nucleobase sequence of the modified oligonucleotide comprises at least 12, at least 13, at least 14, at least 15, at least 16, at least 17, at least 18, at least 19, at least 20, at least 21, at least 22, or 23 nucleobases of any of SEQ ID NOS: 3058-3063; wherein the modified oligonucleotide comprises at least one modification selected from a modified sugar moiety and a modified internucleoside linkage.

Embodiment 52. An oligomeric duplex, comprising a first oligomeric compound comprising a first modified oligonucleotide and a second oligomeric compound comprising a second modified oligonucleotide, wherein the first oligomeric compound is an oligomeric compound of embodiment 51.

Embodiment 53. The oligomeric duplex of embodiment 52, wherein at least one nucleoside of the first modified oligonucleotide comprises a modified sugar moiety selected from a 2'-OMe sugar moiety, a 2'-F sugar moiety, and a 2'-MOE sugar moiety.

Embodiment 54. The oligomeric duplex of embodiment 53, wherein the first modified oligonucleotide consists of 23 linked nucleosides and has a sugar motif of efyyyyyyyyyyyyfyfyyyyyyy, wherein each "e" represents a T-MOE sugar moiety, each "f" represents a 2'-F sugar moiety, and each "y" represents a 2'-OMe sugar moiety.

Embodiment 55. The oligomeric duplex of embodiments 52-54 wherein the first modified oligonucleotide comprises a 5'-stabilized phosphate group.

Embodiment 56. The oligomeric duplex of embodiment 55, wherein the 5'-stabilized phosphate group is 5'-vinylphosphonate.

Embodiment 57. The oligomeric duplex of any of embodiments 52-56, wherein the first modified oligonucleotide consists of 23 linked nucleosides and has the internucleoside linkage motif of ssooooooooooooooooooss, wherein each "s" represents a phosphorothioate internucleoside linkage and each "o" represents a phosphodiester internucleoside linkage.

Embodiment 58. The oligomeric duplex of any of embodiments 52-56, wherein the second modified oligonucleotide consists of 12 to 30 linked nucleosides and comprises a complementary region of at least 12 nucleosides that is at least 90% complementary to the nucleobase sequence of an equal length region of the first modified oligonucleotide.

Embodiment 59. The oligomeric duplex of embodiment 58, wherein the complementary region is 21 nucleosides.

Embodiment 60. The oligomeric duplex of embodiment 58 or embodiment 59, wherein the complementary region is at least 95% or is 100% complementary to an equal length portion of the first modified oligonucleotide.

Embodiment 61. The oligomeric duplex of any of embodiments 58-60, wherein at least one nucleoside of the second modified oligonucleotide comprises a 2'-OMe sugar moiety, a 2'-F sugar moiety, or a 2'-MOE sugar moiety.

Embodiment 62. The oligomeric duplex of any of embodiments 52-61, wherein the second modified oligonucleotide consists of 21 linked nucleosides and has a sugar motif of: yyyyyyfyfffyyyyyyyyyy, wherein each "f" represents a 2'-F sugar moiety and each "y" represents a 2'-OMe sugar moiety.

Embodiment 63. The oligomeric duplex of any of embodiments 52-62, wherein the second oligomeric compound comprises a conjugate group.

Embodiment 64. The oligomeric duplex of embodiment 63, wherein the second oligomeric compound comprises a conjugate group attached through a modified phosphoramidate internucleoside linkage.

Embodiment 65. The oligomeric duplex of embodiment 63 or embodiment 64, wherein the conjugate group is $C_{12}$-$C_{20}$ alkyl.

Embodiment 66. The oligomeric duplex of any of embodiments 63-65, wherein the conjugate group is $C_{16}$ alkyl.

Embodiment 67. The oligomeric duplex of any of embodiments 63-66, wherein the second modified oligonucleotide consists of 21 linked nucleosides and has the internucleoside linkage motif of ssooo[C16muP]ooooooooooooss, wherein each "o" represents a phosphodiester internucleoside linkage, each "s" represents a phosphorothioate internucleoside linkage, and each "[C16muP]" represents a modified phosphoramidate internucleoside linkage, as shown below:

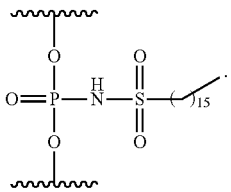

Embodiment 68. An antisense compound comprising or consisting of an oligomeric compound of any of embodiments 1-49 or 51 or an oligomeric duplex of any of embodiments 50 or 53-67.

Embodiment 69. A chirally enriched population of oligomeric compounds of any of embodiments 1-49 or 51, wherein the population is enriched for modified oligonucleotides comprising at least one particular phosphorothioate internucleoside linkage having a particular stereochemical configuration.

Embodiment 70. The chirally enriched population of embodiment 69, wherein the population is enriched for modified oligonucleotides comprising at least one particular phosphorothioate internucleoside linkage having the (Sp) configuration.

Embodiment 71. The chirally enriched population of embodiment 69, wherein the population is enriched for modified oligonucleotides comprising at least one particular phosphorothioate internucleoside linkage having the (Rp) configuration.

Embodiment 72. The chirally enriched population of embodiment 69, wherein the population is enriched for modified oligonucleotides having a particular, independently selected stereochemical configuration at each phosphorothioate internucleoside linkage.

Embodiment 73. The chirally enriched population of embodiment 72, wherein the population is enriched for modified oligonucleotides having the (Rp) configuration at one particular phosphorothioate internucleoside linkage and the (Sp) configuration at each of the remaining phosphorothioate internucleoside linkages.

Embodiment 74. The chirally enriched population of embodiment 72, wherein the population is enriched for modified oligonucleotides having at least 3 contiguous phosphorothioate internucleoside linkages in the Sp, Sp, and Rp configurations, in the 5' to 3' direction.

Embodiment 75. A population of oligomeric compounds of any of embodiments 1-49 or 51, wherein all of the phosphorothioate internucleoside linkages of the modified oligonucleotide are stereorandom.

Embodiment 76. A pharmaceutical composition comprising an oligomeric compound of any of embodiments 1-49 or 51, an oligomeric duplex of any of embodiments 50 or 52-67, an antisense compound of embodiment 68, or a population of any of embodiments 69-75 and a pharmaceutically acceptable carrier or diluent.

Embodiment 77. The pharmaceutical composition of embodiment 76, wherein the pharmaceutically acceptable diluent is artificial cerebrospinal fluid, or phosphate-buffered saline (PBS).

Embodiment 78. The pharmaceutical composition of embodiment 77, wherein the pharmaceutical composition consists essentially of the oligomeric compound, the oligomeric duplex, the antisense compound, or the population and artificial cerebral spinal fluid.

Embodiment 79. The pharmaceutical composition of embodiment 77, wherein the pharmaceutical composition consists essentially of the oligomeric compound, the oligomeric duplex, the antisense compound, or the population and PBS.

Embodiment 80. A method comprising administering to a subject the oligomeric compound of any of embodiments 1-49 or 51, the oligomeric duplex of any of embodiments 50 or 52-57, the antisense compound of embodiment 68, the population of any of embodiments 69-75, or the pharmaceutical composition of any of embodiments 76-79.

Embodiment 81. A method of treating a disease or disorder associated with APP comprising administering to a subject having or at risk for developing a disease or disorder associated with APP a therapeutically effective amount of an oligomeric compound of any of embodiments 1-49 or 51, an oligomeric duplex of any of embodiments 50 or 52-67, an antisense compound of embodiment 68, a population of any of embodiments 69-75 or a pharmaceutical composition according to any of embodiments 76-79, thereby treating the disease or disorder associated with APP.

Embodiment 82. The method of embodiment 81, wherein the APP-associated disease is sporadic Alzheimer's Disease, genetic/familial Alzheimer's Disease, Alzheimer's Disease in a Down Syndrome patient, or Cerebral Amyloid Angiopathy.

Embodiment 83. The method of any of embodiments 80-82 wherein administering the oligomeric compound of any of embodiments 1-49 or 51, the oligomeric duplex of any of embodiments 50 or 52-57, the antisense compound of embodiment 68, the population of any of embodiments 69-75, or the pharmaceutical composition of any of embodiments 76-79 ameliorates at least one symptom or hallmark of the APP-associated disease or disorder.

Embodiment 84. The method of embodiment 83, wherein administering the oligomeric compound of any of embodiments 1-49 or 51, the oligomeric duplex of any of embodiments 50 or 52-57, the antisense compound of embodiment 68, the population of any of embodiments 69-75, or the pharmaceutical composition of any of embodiments 76-79 reduces or slows cognitive impairment, reduces or slows decline in memory and/or language skills, improves behavioral and psychological symptoms, reduces apathy, improves motivation, reduces gait disturbances, reduces seizures, reduces or slows progressive dementia, or reduces abnormal amyloid deposits.

Embodiment 85. The method of any of embodiments 80-84, wherein APP protein levels in the subject are reduced.

Embodiment 86. A method of reducing expression of APP in a cell comprising contacting the cell with the oligomeric compound of any of embodiments 1-49 or 51, the oligomeric duplex of any of embodiments 50 or 52-57, the antisense compound of embodiment 68, the population of any of embodiments 69-75, or the pharmaceutical composition of any of embodiments 76-79.

Embodiment 87. The method of embodiment 86, wherein the cell is a cortical brain cell, or a hippocampal cell.

Embodiment 88. Use of the oligomeric compound of any of embodiments 1-49 or 51, the oligomeric duplex of any of embodiments 50 or 52-57, the antisense compound of embodiment 68, the population of any of embodiments 69-75, or the pharmaceutical composition of any of embodiments 76-79 for treating a disease or disorder associated with APP.

Embodiment 89. Use of the oligomeric compound of any of embodiments 1-49 or 51, the oligomeric duplex of any of embodiments 50 or 52-57, the antisense compound of embodiment 68, the population of any of embodiments 69-75, or the pharmaceutical composition of any of embodiments 76-79 in the manufacture of a medicament for treating a disease or disorder associated with APP.

Embodiment 90. The use of embodiment 88 or 89, wherein the disease associated with APP is sporadic Alzheimer's Disease, genetic/familial Alzheimer's Disease, Alzheimer's Disease in a Down Syndrome patient, or Cerebral Amyloid Angiopathy.

Embodiment 91. The method of any of embodiments 80-85, wherein the subject is human.

Embodiment 92. The method of embodiment 86 or embodiment 87, wherein the cell is a human.

Embodiment 93. A modified oligonucleotide according to the following chemical structure:

(SEQ ID NO: 273)

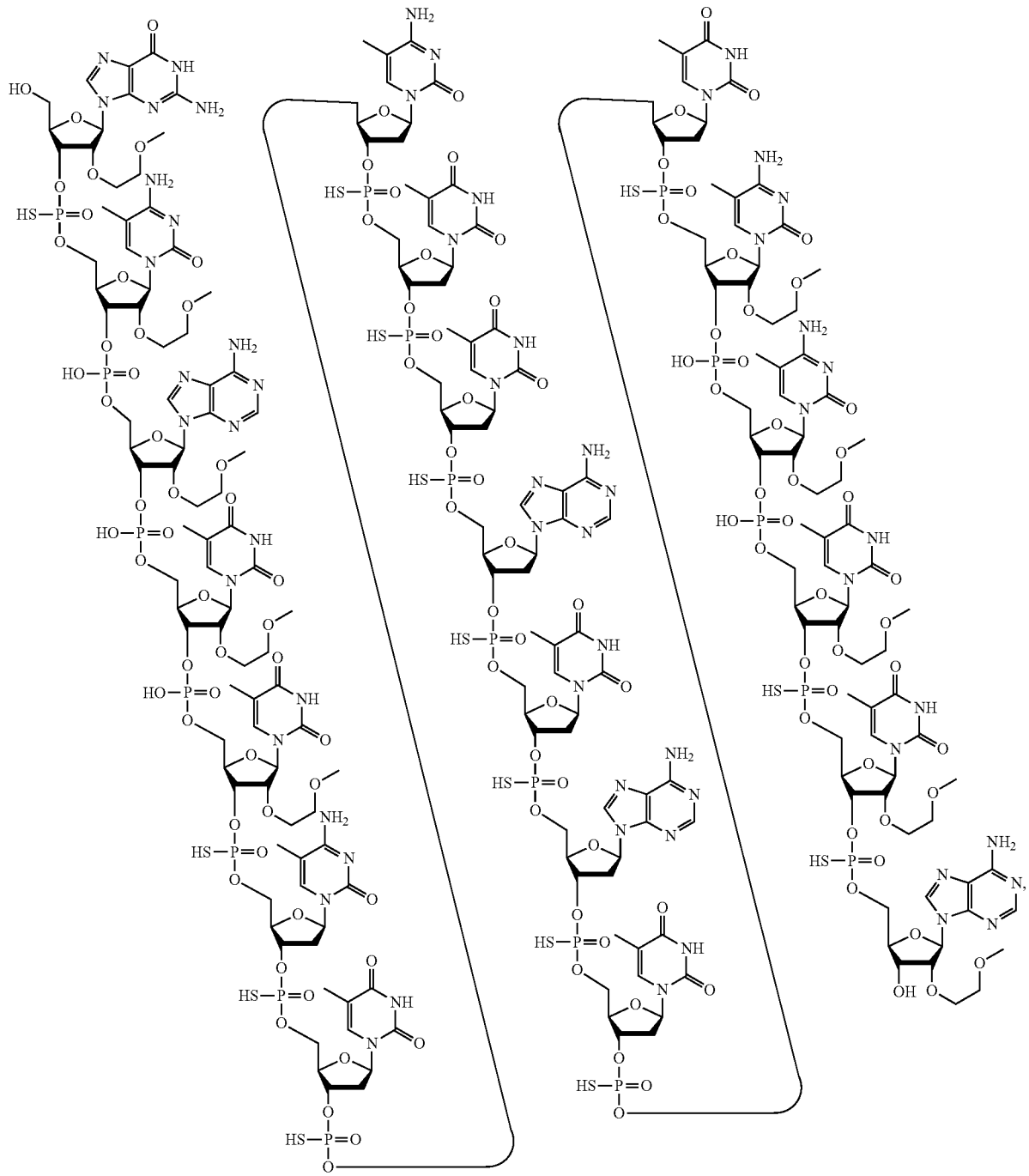

or a salt thereof.

Embodiment 94. The modified oligonucleotide of embodiment 93, which is the sodium salt or the potassium ' ' salt.
Embodiment 95. A modified oligonucleotide according to the following chemical structure:
(SEQ ID NO: 273)
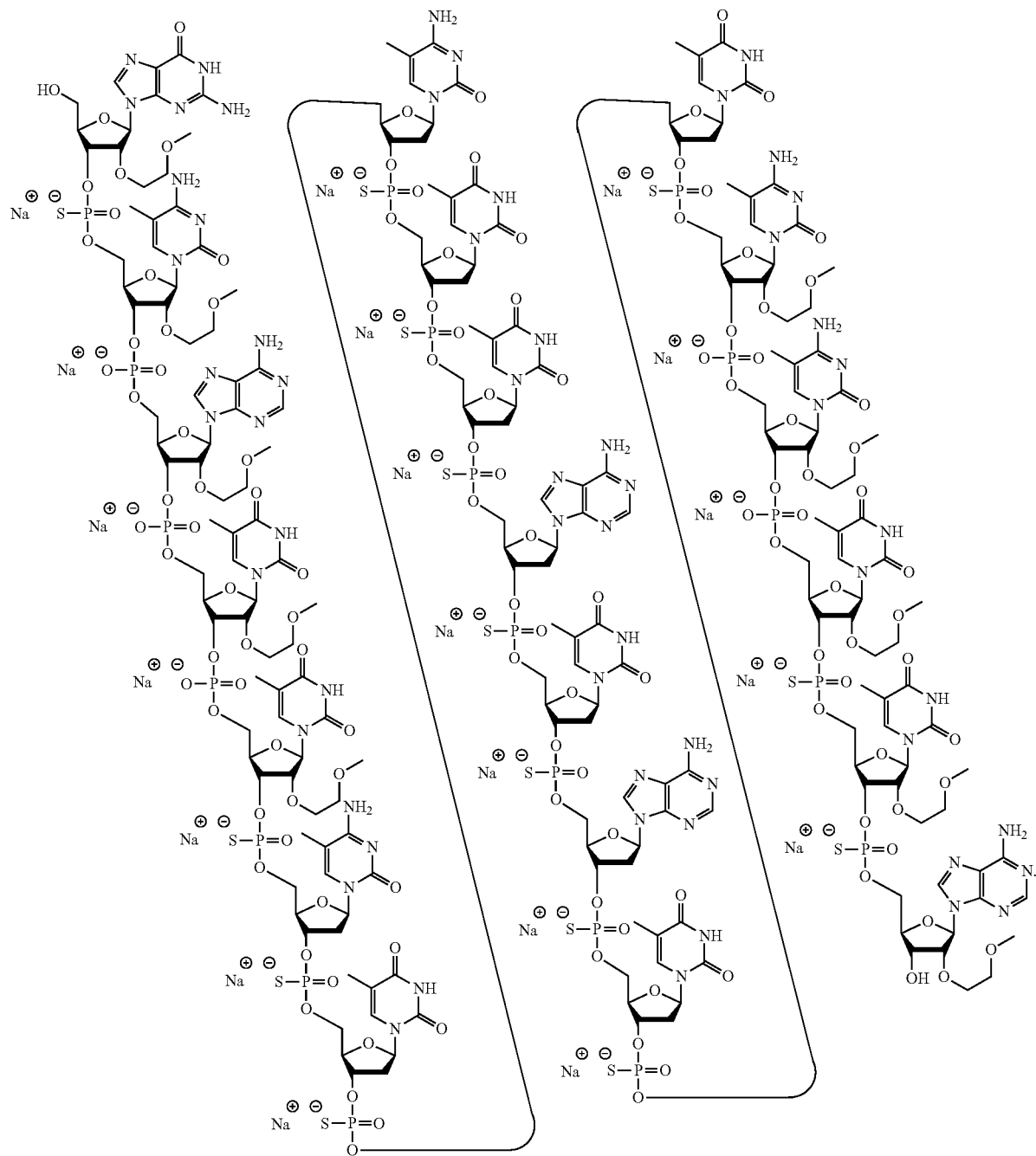

Embodiment 96. A modified oligonucleotide according to the following chemical structure:
(SEQ ID NO: 452)
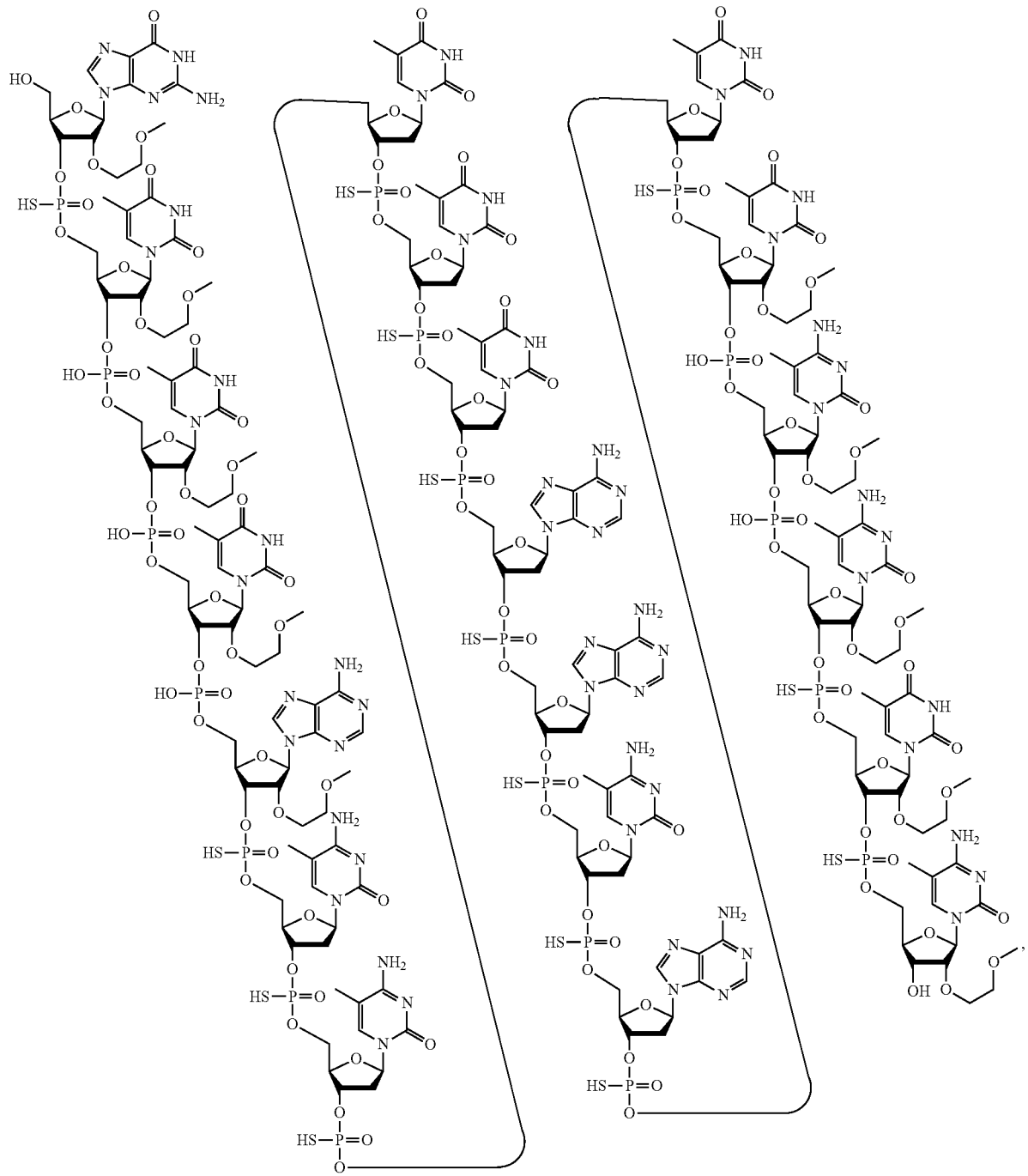
or a salt thereof.
Embodiment 97. The modified oligonucleotide of embodiment 96, which is the sodium salt or the potassium salt.

Embodiment 98. A modified oligonucleotide according to the following chemical structure:
(SEQ ID NO: 452)
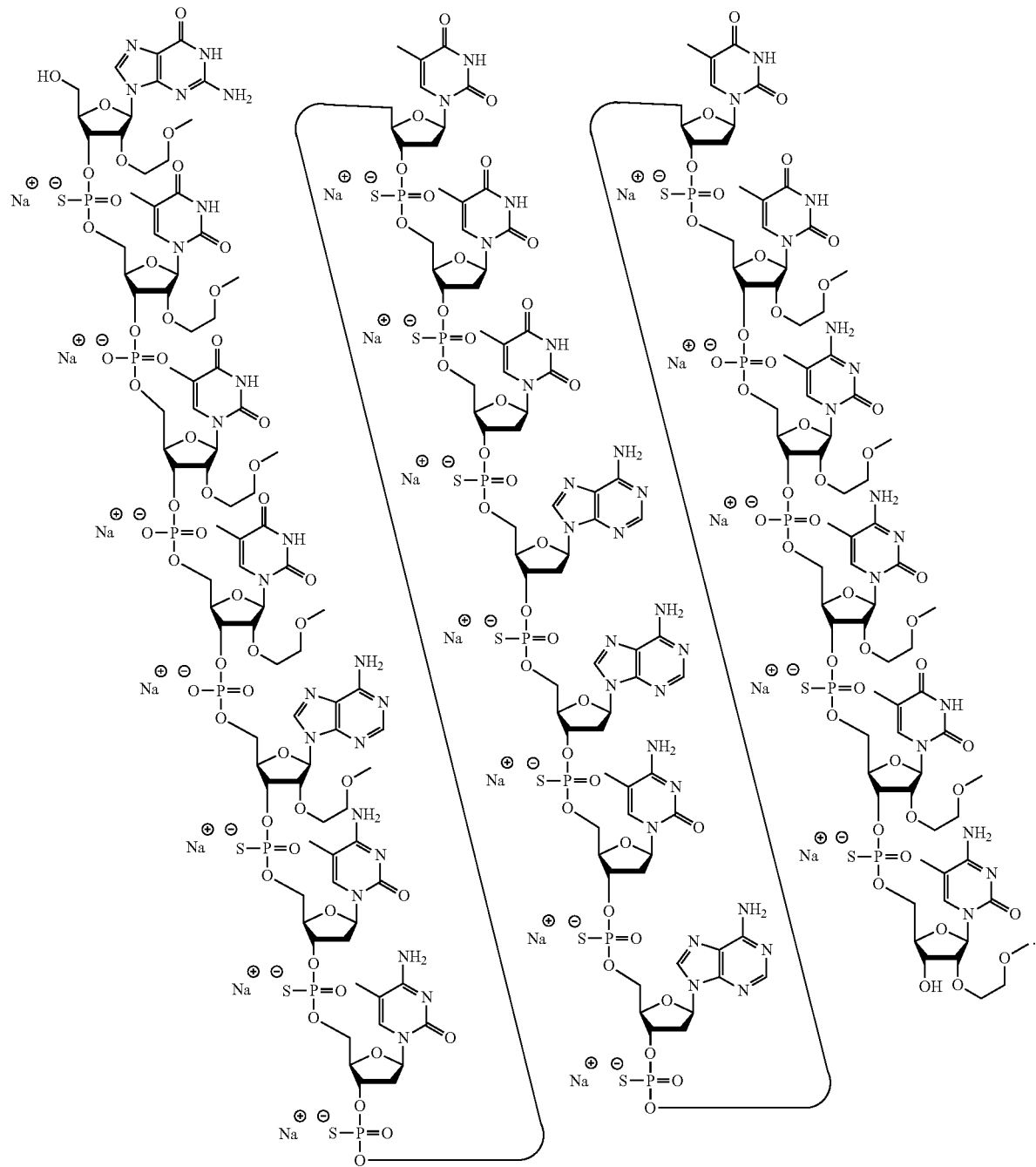

Embodiment 99. A modified oligonucleotide according to the following chemical structure:
(SEQ ID NO: 462)
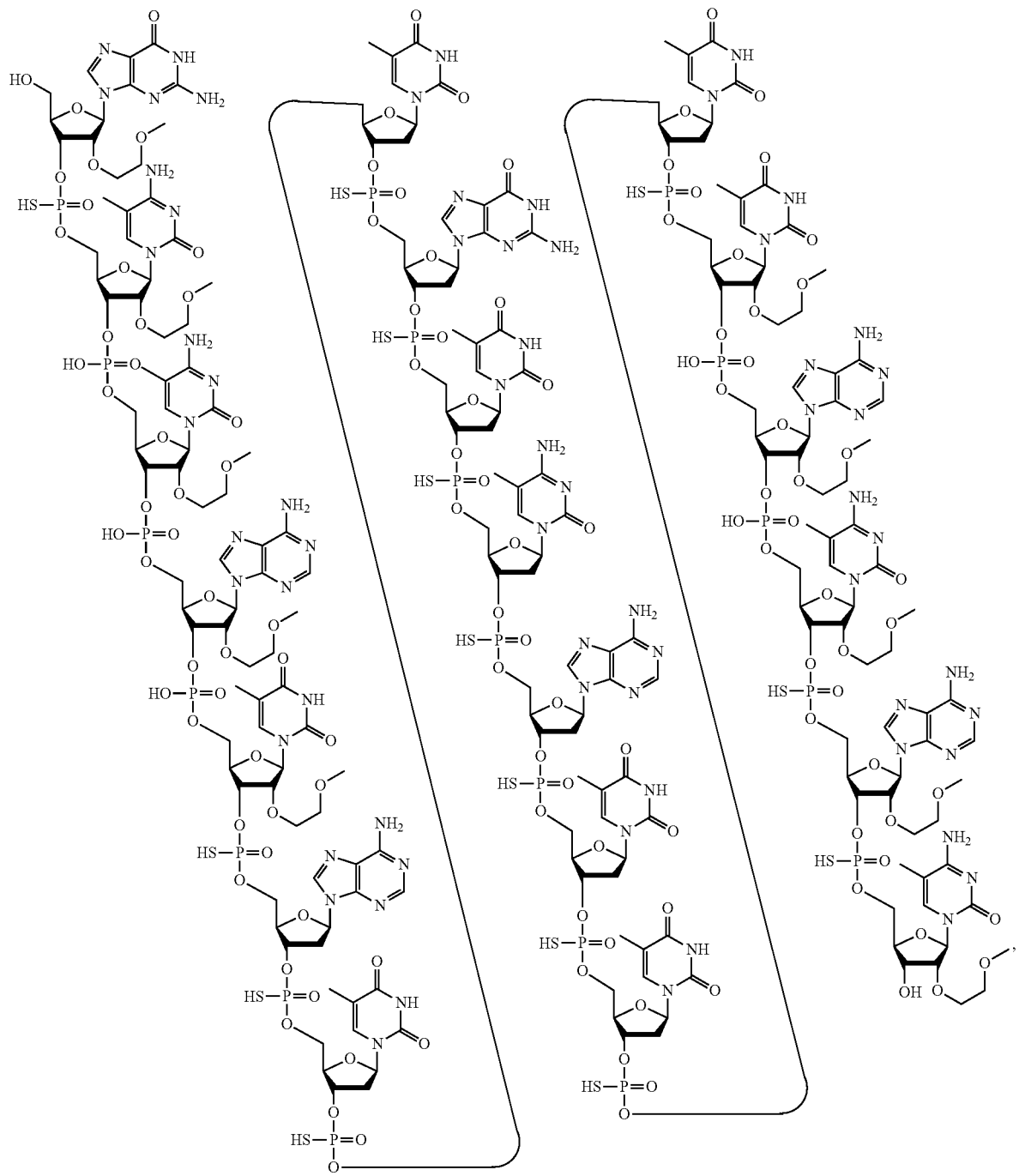
or a salt thereof.
Embodiment 100. The modified oligonucleotide of embodiment 99, which is the sodium salt or the potassium salt.

Embodiment 101. A modified oligonucleotide according to the following chemical structure:
(SEQ ID NO: 462)
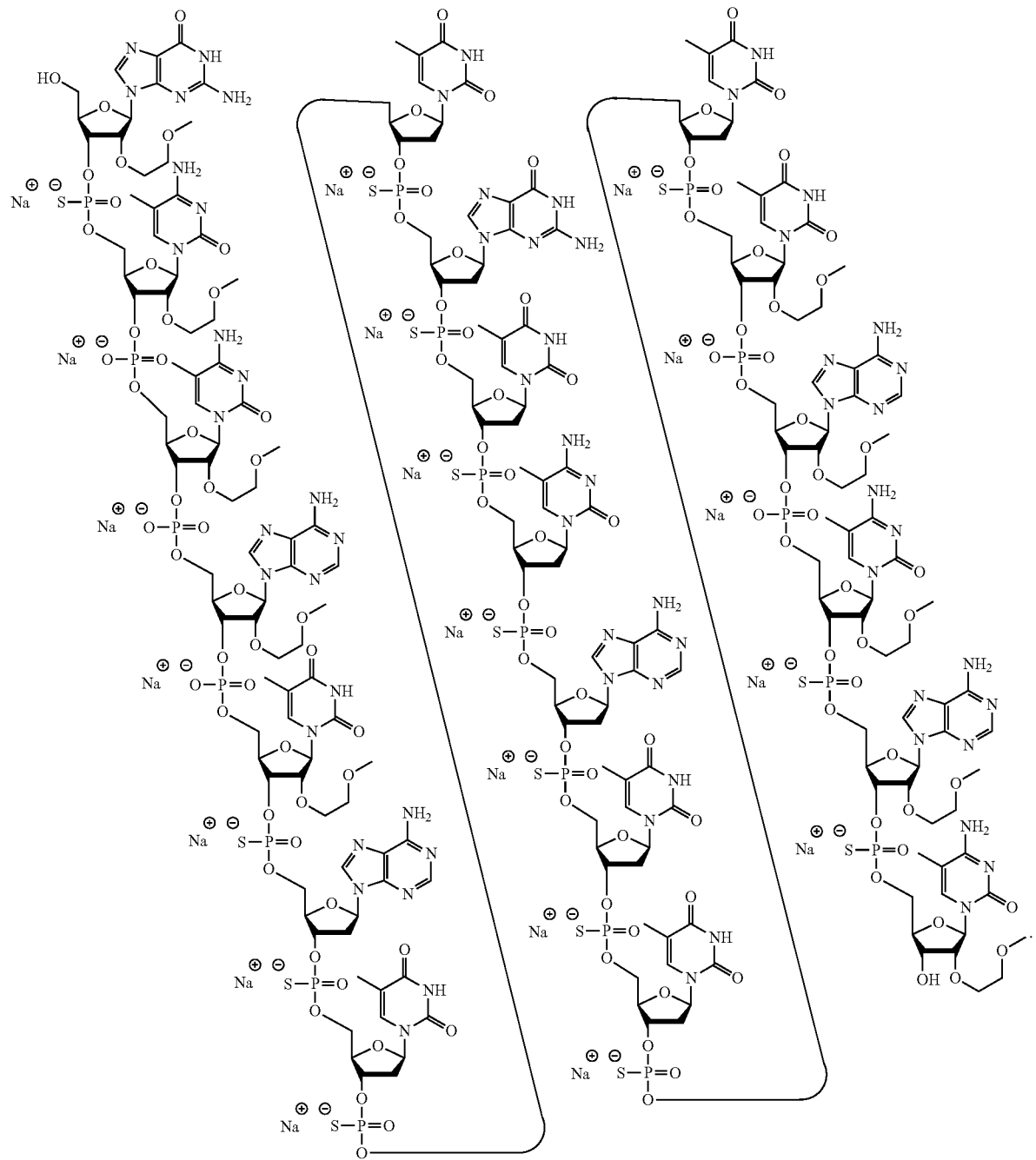

Embodiment 102. A modified oligonucleotide according to the following chemical structure:
(SEQ ID NO: 482)
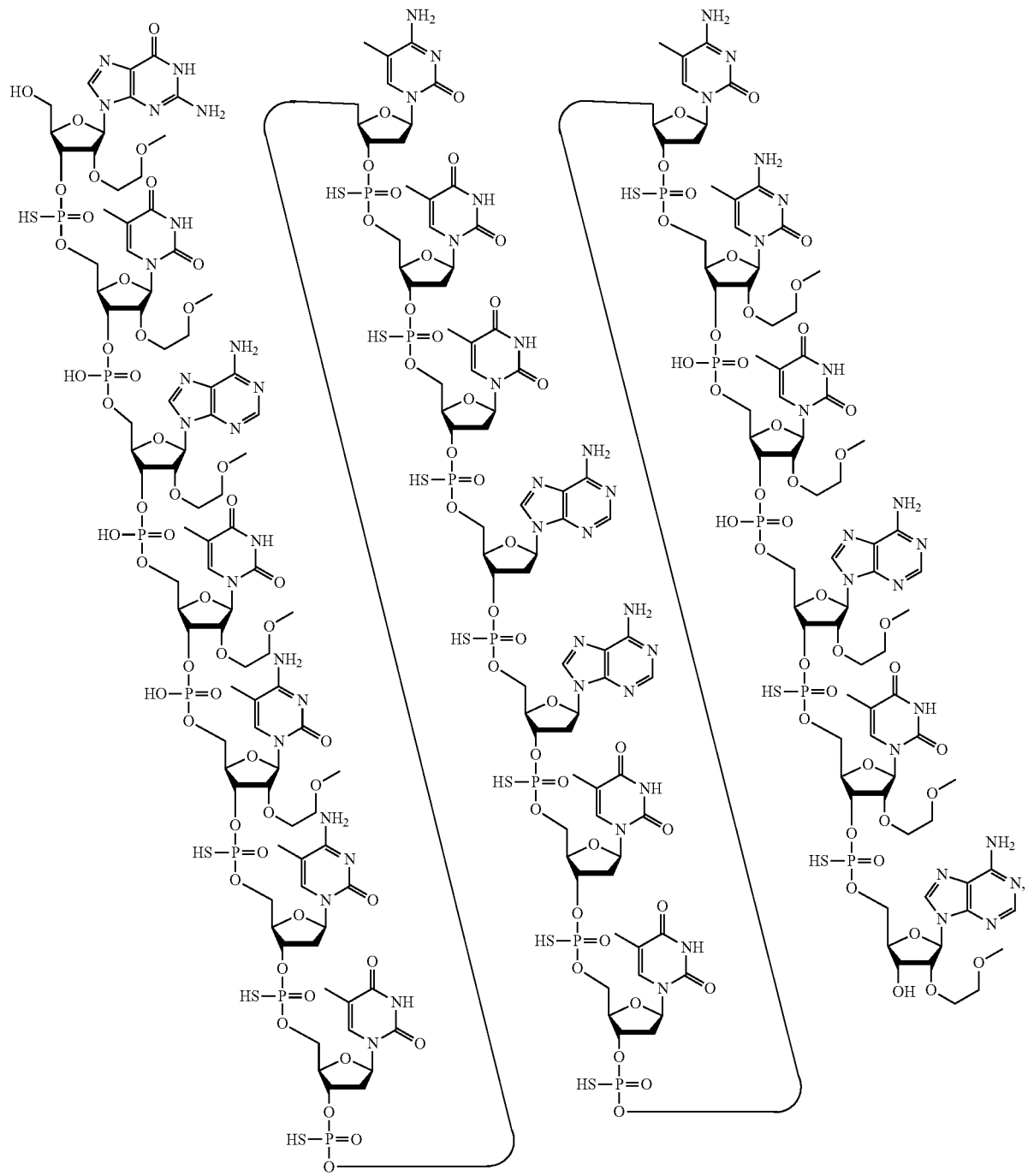
or a salt thereof.
Embodiment 103. The modified oligonucleotide of embodiment 102, which is the sodium salt or the potassium salt.

Embodiment 104. A modified oligonucleotide according to the following chemical structure:
(SEQ ID NO: 482)
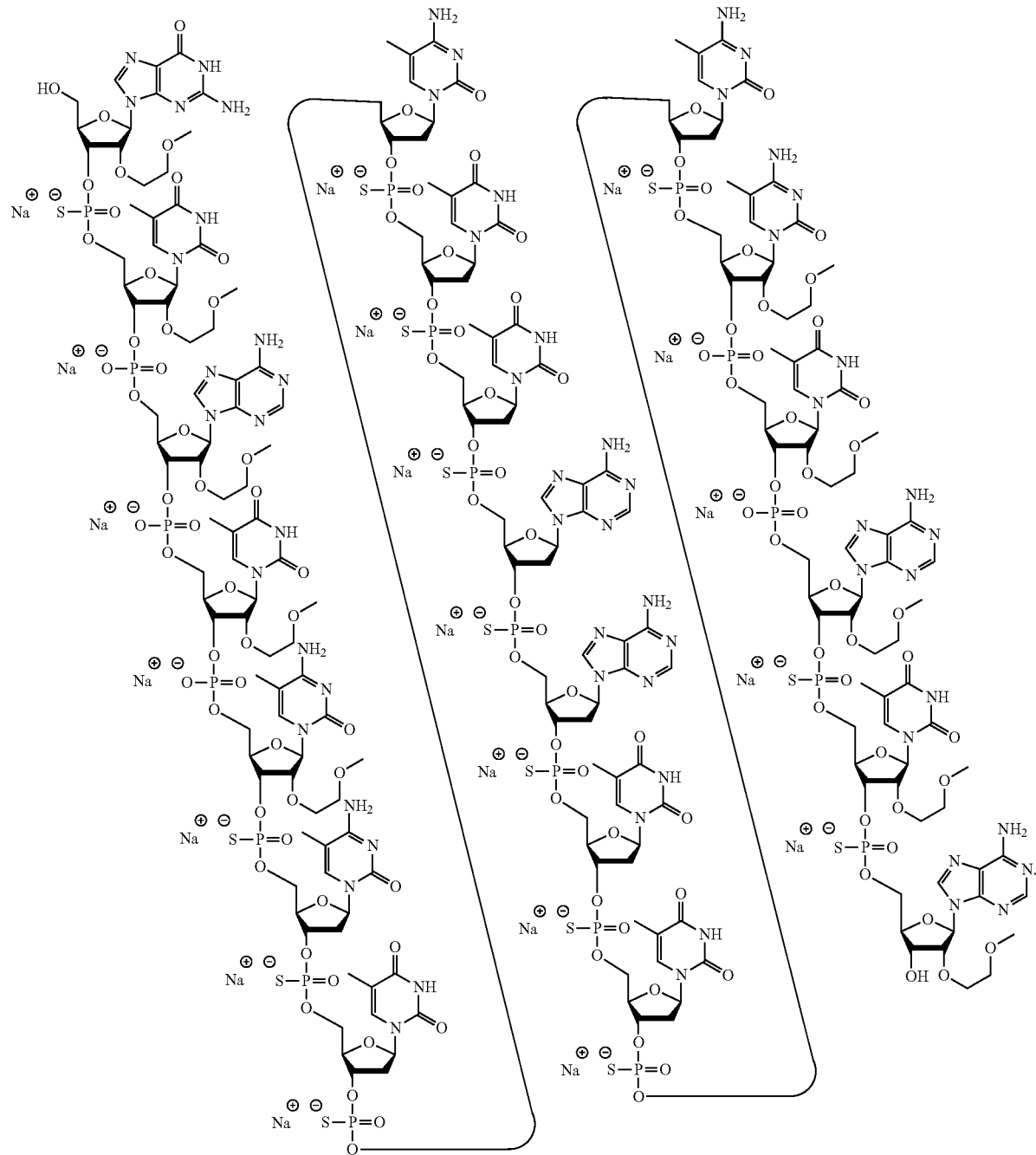

Embodiment 105. A modified oligonucleotide according to the following chemical structure:
(SEQ ID NO: 1064)
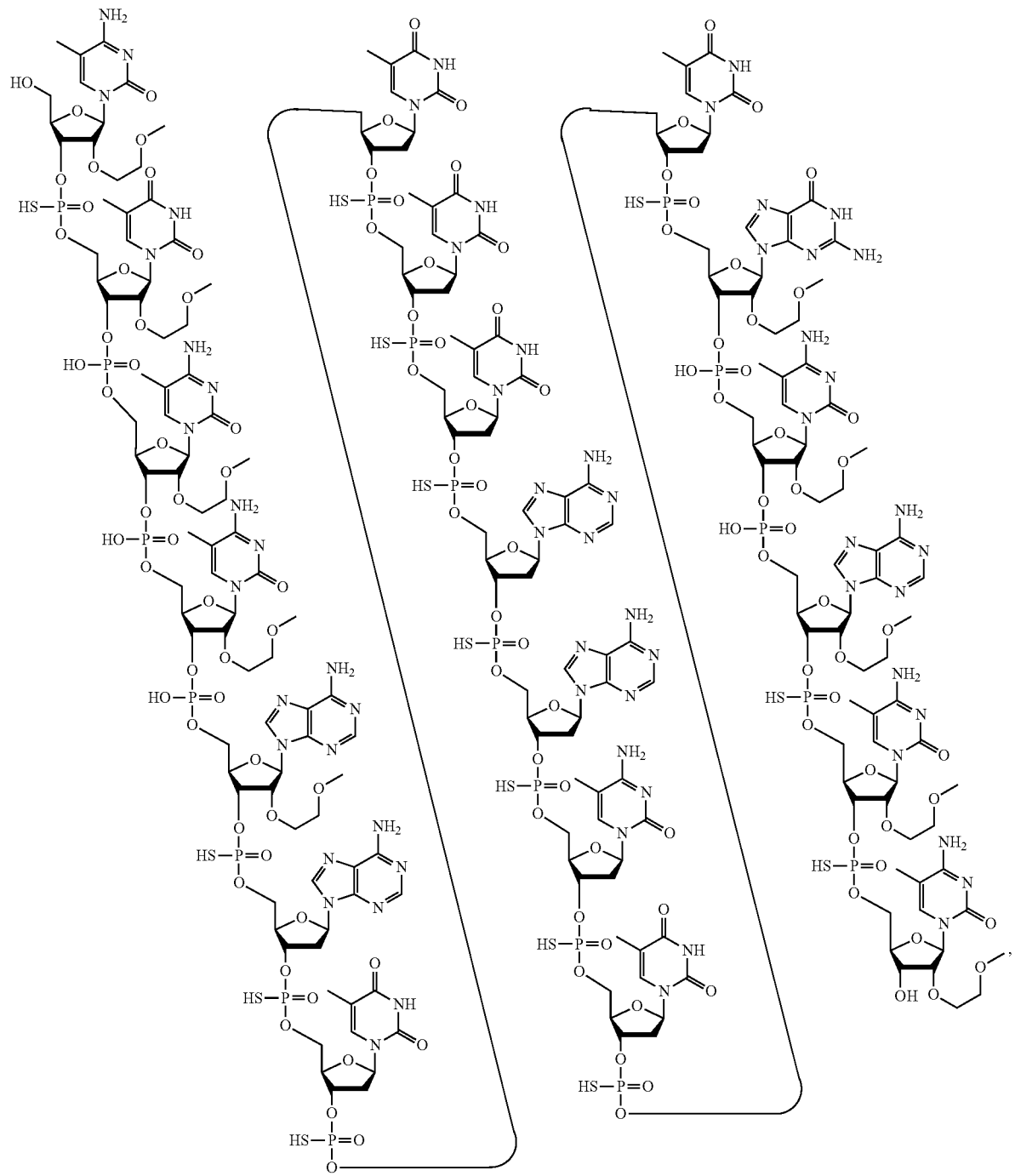
or a salt thereof.
Embodiment 106. The modified oligonucleotide of embodiment 105, which is the sodium salt or the potassium salt.

Embodiment 107. A modified oligonucleotide according to the following chemical structure:
(SEQ ID NO: 1064)
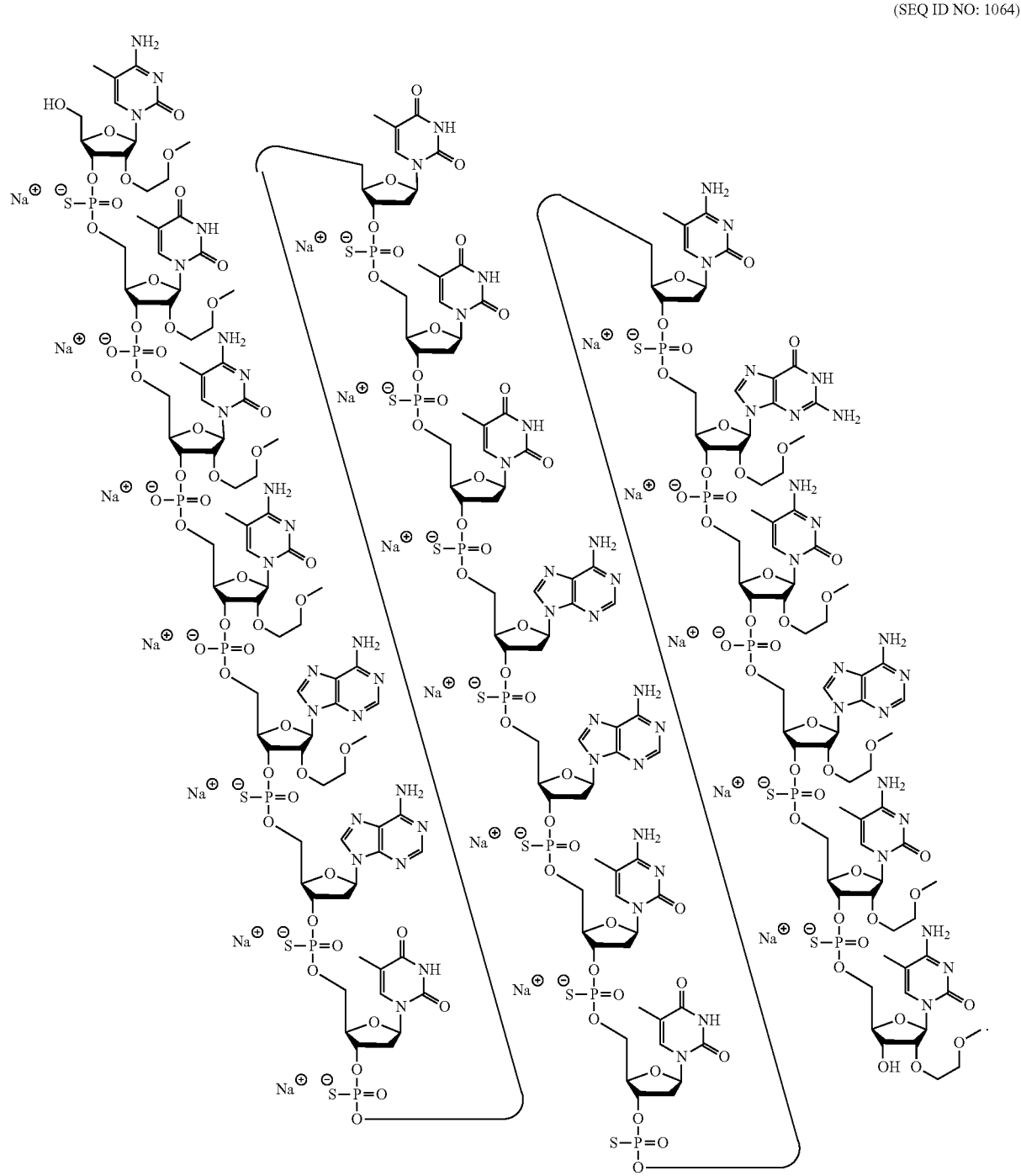

Embodiment 108. A modified oligonucleotide according to the following chemical structure:
(SEQ ID NO: 2225)
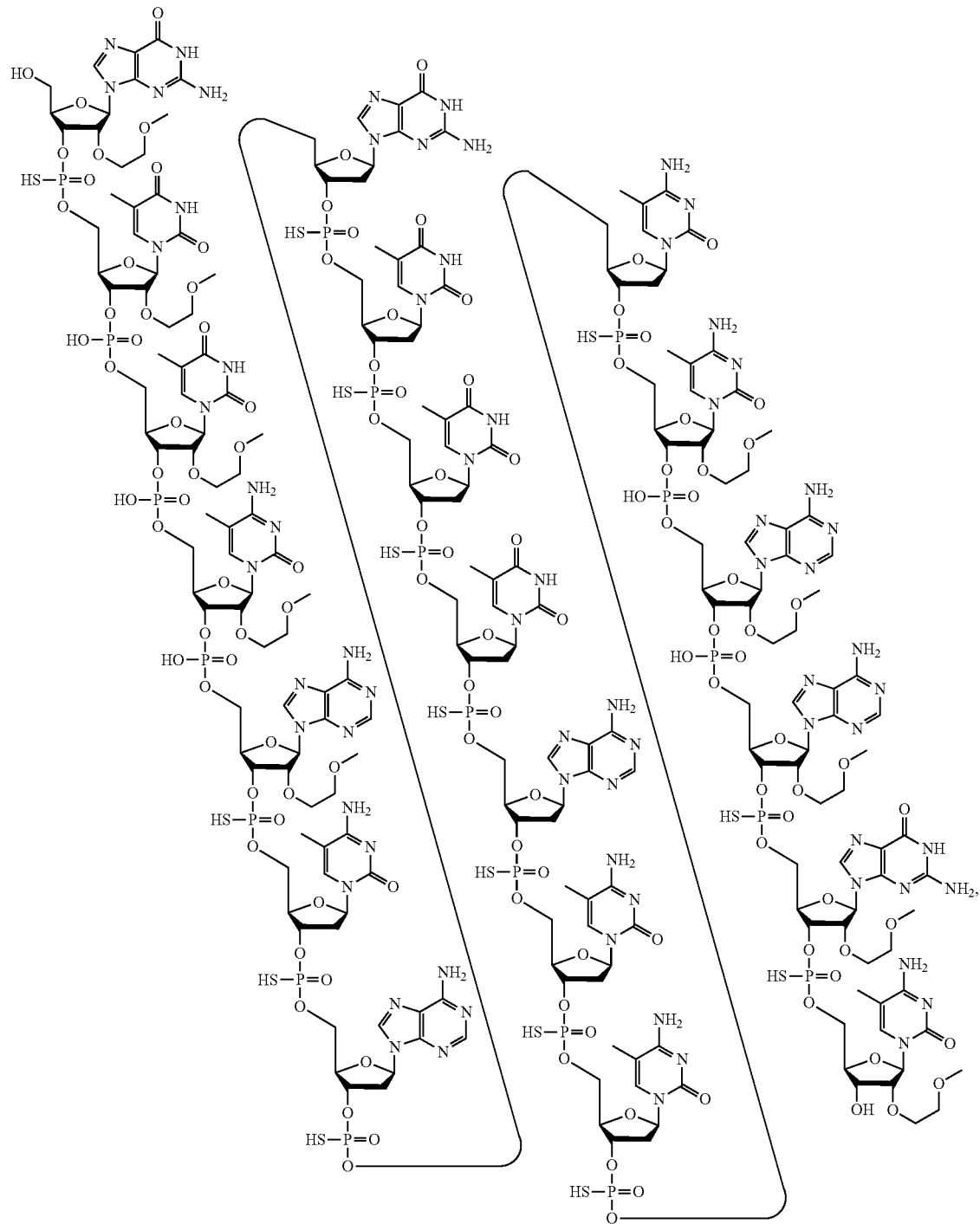
or a salt thereof.
Embodiment 109. The modified oligonucleotide of embodiment 108, which is the sodium salt or the potassium salt.
Embodiment 110. A modified oligonucleotide according to the following chemical structure:

(SEQ ID NO: 2225)

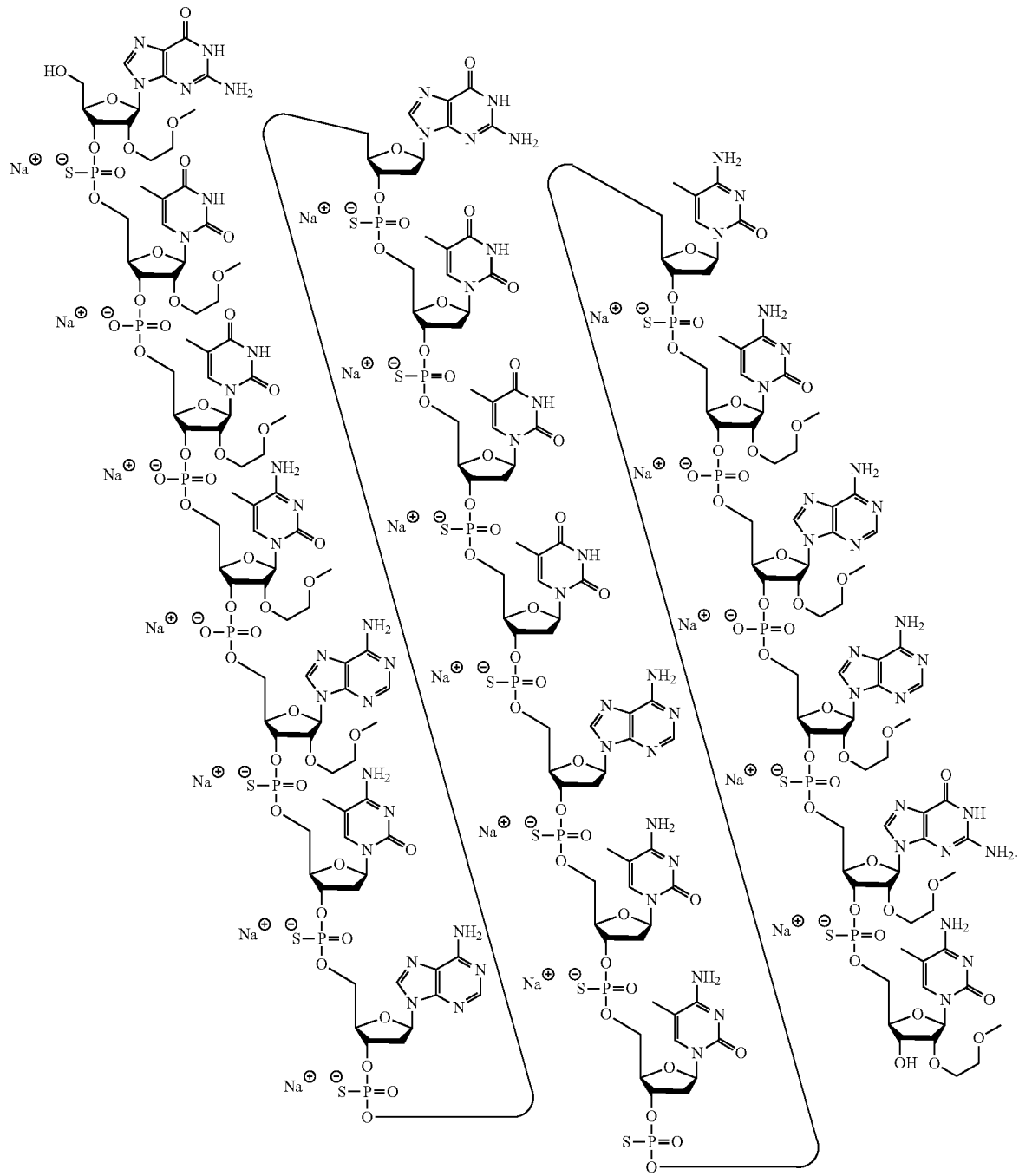

Embodiment 111. An oligomeric compound comprising a modified oligonucleotide according to the following chemical notation: $G_{es}{}^mC_{eo}A_{eo}T_{eo}T_{es}{}^mC_{ds}T_{ds}{}^mC_{ds}T_{ds}T_{ds}A_{ds}A_{ds}T_{ds}T_{ds}{}^mC_{eo}{}^mC_{eo}T_{es}T_{es}A_e$ (SEQ ID NO: 273), wherein:
A=an adenine nucleobase,
$^mC$=a 5-methyl cytosine nucleobase,
G=a guanine nucleobase,
T=a thymine nucleobase,
e=a 2' MOE sugar moiety, d=a 2'-β-D deoxyribosyl sugar moiety,
s=a phosphorothioate internucleoside linkage, and
o=a phosphodiester internucleoside linkage.

Embodiment 112. An oligomeric compound comprising a modified oligonucleotide according to the following chemical notation: $G_{es}T_{eo}T_{eo}T_{eo}A_{es}{}^mC_{ds}{}^mC_{ds}T_{ds}T_{ds}T_{ds}A_{ds}A_{ds}{}^mC_{ds}A_{ds}T_{ds}T_{eo}{}^mC_{eo}{}^mC_{es}T_{es}{}^mC_e$ (SEQ ID NO: 452), wherein:
A=an adenine nucleobase,
$^mC$=a 5-methyl cytosine nucleobase, G=a guanine nucleobase,
T=a thymine nucleobase,
e=a 2' MOE sugar moiety,
d=a 2'-β-D deoxyribosyl sugar moiety,
s=a phosphorothioate internucleoside linkage, and
o=a phosphodiester internucleoside linkage.

Embodiment 113. An oligomeric compound comprising a modified oligonucleotide according to the following chemical notation: $G_{es}{}^mC_{eo}{}^mC_{eo}A_{eo}T_{es}A_{ds}T_{ds}T_{ds}G_{ds}T_{ds}{}^mC_{ds}A_{ds}T_{ds}T_{ds}T_{ds}T_{eo}A_{eo}{}^mC_{es}A_{es}{}^mC_e$ (SEQ ID NO: 462),
wherein:
A=an adenine nucleobase,
$^mC$=a 5-methyl cytosine nucleobase,
G=a guanine nucleobase,
T=a thymine nucleobase,
e=a 2' MOE sugar moiety,
d=a 2'-β-D deoxyribosyl sugar moiety,
s=a phosphorothioate internucleoside linkage, and
o=a phosphodiester internucleoside linkage.

Embodiment 114. An oligomeric compound comprising a modified oligonucleotide according to the following chemical notation: $G_{es}T_{eo}A_{eo}T_{eo}{}^mC_{es}{}^mC_{ds}T_{ds}{}^mC_{ds}T_{ds}T_{ds}A_{ds}A_{ds}T_{ds}T_{ds}{}^mC_{ds}{}^mC_{eo}T_{eo}A_{es}T_{es}A_e$(SEQ ID NO: 482),
wherein:
A=an adenine nucleobase,
$^mC$=a 5-methyl cytosine nucleobase,
G=a guanine nucleobase,
T=a thymine nucleobase,
e=a 2' MOE sugar moiety,
d=a 2'-β-D deoxyribosyl sugar moiety,
s=a phosphorothioate internucleoside linkage, and
o=a phosphodiester internucleoside linkage.

Embodiment 115. An oligomeric compound comprising a modified oligonucleotide according to the following chemical notation: $^mC_{es}T_{eo}{}^mC_{eo}{}^mC_{eo}A_{es}A_{ds}T_{ds}T_{ds}T_{ds}T_{ds}A_{ds}A_{ds}{}^mC_{ds}T_{ds}T_{ds}G_{eo}{}^mC_{eo}A_{es}{}^mC_{es}{}^mC_e$ (SEQ ID NO: 1064),
wherein:
A=an adenine nucleobase,
$^mC$=a 5-methyl cytosine nucleobase,
G=a guanine nucleobase,
T=a thymine nucleobase,
e=a 2' MOE sugar moiety,
d=a 2'-β-D deoxyribosyl sugar moiety,
s=a phosphorothioate internucleoside linkage, and
o=a phosphodiester internucleoside linkage.

Embodiment 116. An oligomeric compound comprising a modified oligonucleotide according to the following chemical notation: $G_{es}T_{eo}T_{eo}{}^mC_{eo}A_{es}{}^mC_{ds}A_{ds}G_{ds}T_{ds}T_{ds}T_{ds}A_{ds}{}^mC_{ds}{}^mC_{ds}{}^mC_{ds}{}^mC_{eo}A_{eo}A_{es}G_{es}{}^mC_e$ (SEQ ID NO: 2225),
wherein:
A=an adenine nucleobase,
$^mC$=a 5-methyl cytosine nucleobase,
G=a guanine nucleobase,
T=a thymine nucleobase,
e=a 2' MOE sugar moiety,
d=a 2'-β-D deoxyribosyl sugar moiety,
s=a phosphorothioate internucleoside linkage, and
o=a phosphodiester internucleoside linkage.

Embodiment 117. The oligomeric compound of any of embodiments 111-116, wherein the modified oligonucleotide is covalently linked to a conjugate group.

Embodiment 118. A chirally enriched population of modified oligonucleotides of any of embodiments 93-110 or oligomeric compounds of any of embodiments 111-116, wherein the population is enriched for modified oligonucleotides comprising at least one particular phosphorothioate internucleoside linkage having a particular stereochemical configuration.

Embodiment 119. The chirally enriched population of embodiment 118, wherein the population is enriched for modified oligonucleotides comprising at least one particular phosphorothioate internucleoside linkage having the (Sp) configuration.

Embodiment 120. The chirally enriched population of embodiment 118, wherein the population is enriched for modified oligonucleotides comprising at least one particular phosphorothioate internucleoside linkage having the dip) configuration.

Embodiment 121. The chirally enriched population of embodiment 118, wherein the population is enriched for modified oligonucleotides having a particular, independently selected stereochemical configuration at each phosphorothioate internucleoside linkage.

Embodiment 122. The chirally enriched population of embodiment 121, wherein the population is enriched for modified oligonucleotides having the dip) configuration at one particular phosphorothioate internucleoside linkage and the (Sp) configuration at each of the remaining phosphorothioate internucleoside linkages.

Embodiment 123. The chirally enriched population of embodiment 121, wherein the population is enriched for modified oligonucleotides having at least 3 contiguous phosphorothioate internucleoside linkages in the Sp, Sp, and lip configurations, in the 5' to 3' direction.

Embodiment 124. A population of modified oligonucleotides of any of embodiments 93-110 or oligomeric compounds of any of embodiments 111-116, wherein all of the phosphorothioate internucleoside linkages of the modified oligonucleotide are stereorandom.

Embodiment 125. A pharmaceutical composition comprising a modified oligonucleotide of any of embodiments 93-110, an oligomeric compound of any of embodiments 111-116, or a population of any of embodiments 118-124, and a pharmaceutically acceptable carrier or diluent.

Embodiment 126. The pharmaceutical composition of embodiment 125, wherein the pharmaceutically acceptable diluent is artificial cerebrospinal fluid, or phosphate-buffered saline (PBS).

Embodiment 127. The pharmaceutical composition of embodiment 126, wherein the pharmaceutical composition consists essentially of the modified oligonucleotide, the oligomeric compound, or the population and artificial cereal spinal fluid.

Embodiment 128. The pharmaceutical composition of embodiment 126, wherein the pharmaceutical composition consists essentially of the modified oligonucleotide, the oligomeric compound, or the population and PBS.

Embodiment 129. A method comprising administering to a subject the modified oligonucleotide of any of embodiments 93-110, the oligomeric compound of any of embodiments 111-116, the population of any of embodiments 118-124, or the pharmaceutical composition of any of embodiments 125-128.

Embodiment 130. A method of treating a disease or disorder associated with APP comprising administering to a subject having or at risk for developing a disease or disorder associated with APP a therapeutically effective amount of a modified oligonucleotide of any of embodiments 93-110, an oligomeric compound of any of embodiments 111-116, a population of any of embodiments 118-124, or a pharmaceutical composition of any of embodiments 125-128, thereby treating the disease or disorder associated with APP.

Embodiment 131. The method of embodiment 130, wherein the APP-associated disease is sporadic Alzheimer's Disease, genetic/familial Alzheimer's Disease, Alzheimer's Disease in a Down Syndrome patient, or Cerebral Amyloid Angiopathy.

Embodiment 132. The method of any of embodiments 129-131 wherein administering the modified oligonucleotide of any of embodiments 93-110, the oligomeric compound of any of embodiments 111-116, the population of any of embodiments 118-124, or the pharmaceutical composition of any of embodiments 125-128 ameliorates at least one symptom or hallmark of the APP-associated disease or disorder.

Embodiment 133. The method of embodiment 132, wherein administering the modified oligonucleotide of any of embodiments 93-110, the oligomeric compound of any of embodiments 111-116, the population of any of embodiments 118-124, or the pharmaceutical composition of any of embodiments 125-128 reduces or slows cognitive impairment, reduces or slows decline in memory and/or language skills, improves behavioral and psychological symptoms, reduces apathy, improves motivation, reduces gait disturbances, reduces seizures, reduces or slows progressive dementia, or reduces abnormal amyloid deposits.

Embodiment 134. The method of any of embodiments 129-134, wherein APP protein levels in the subject are reduced.

Embodiment 135. A method of reducing expression of APP in a cell comprising contacting the cell with the modified oligonucleotide of any of embodiments 93-110, the oligomeric compound of any of embodiments 111-116, the population of any of embodiments 118-124, or the pharmaceutical composition of any of embodiments 125-128.

Embodiment 136. The method of embodiment 135, wherein the cell is a cortical brain cell, or a hippocampal cell.

Embodiment 137. Use of the modified oligonucleotide of any of embodiments 93-110, the oligomeric compound of any of embodiments 111-116, the population of any of embodiments 118-124, or the pharmaceutical composition of any of embodiments 125-128 for treating a disease or disorder associated with APP.

Embodiment 138. Use of the modified oligonucleotide of any of embodiments 93-110, the oligomeric compound of any of embodiments 111-116, the population of any of embodiments 118-124, or the pharmaceutical composition of any of embodiments 125-128 in the manufacture of a medicament for treating a disease or disorder associated with APP.

Embodiment 139. The use of embodiment 137 or 138, wherein the disease associated with APP is sporadic Alzheimer's Disease, genetic/familial Alzheimer's Disease, Alzheimer's Disease in a Down Syndrome patient, or Cerebral Amyloid Angiopathy.

Embodiment 140. The method of any of embodiments 129-134, wherein the subject is human.

Embodiment 141. The method of embodiment 135 or embodiment 136, wherein the cell is a human cell.

I. Certain Oligonucleotides

In certain embodiments, provided herein are oligomeric compounds comprising oligonucleotides, which consist of linked nucleosides. Oligonucleotides may be unmodified oligonucleotides (RNA or DNA) or may be modified oligonucleotides. Modified oligonucleotides comprise at least one modification relative to unmodified RNA or DNA. That is, modified oligonucleotides comprise at least one modified nucleoside (comprising a modified sugar moiety and/or a modified nucleobase) and/or at least one modified internucleoside linkage. Certain modified nucleosides and modified internucleoside linkages suitable for use in modified oligonucleotides are described below.

A. Certain Modified Nucleosides

Modified nucleosides comprise a modified sugar moiety or a modified nucleobase or both a modified sugar moiety and a modified nucleobase. In certain embodiments, modified nucleosides comprising the following modified sugar moieties and/or the following modified nucleobases may be incorporated into antisense oligonucleotides.

1. Certain Sugar Moieties

In certain embodiments, modified sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more substituent groups none of which bridges two atoms of the furanosyl ring to form a bicyclic structure. Such non bridging substituents may be at any position of the furanosyl, including but not limited to substituents at the 2', 3', 4', and/or 5' positions. In certain embodiments one or more non-bridging substituent of non-bicyclic modified sugar moieties is branched. Examples of 2'-substituent groups suitable for non-bicyclic modified sugar moieties include but are not limited to: 2'-F, 2'-OCH$_3$ ("OMe" or "O-methyl"), and 2'-O(CH$_2$)$_2$OCH$_3$ ("MOE"). In certain embodiments, 2'-substituent groups are selected from among: halo, allyl, amino, azido, SH, CN, OCN, CF$_3$, OCF$_3$, O—C$_1$-C$_{10}$ alkoxy, O—C$_1$-C$_{10}$ substituted alkoxy, O—C$_1$-C$_{10}$ alkyl, O—C$_1$-C$_{10}$ substituted alkyl, S-alkyl, N(R$_m$)-alkyl, O-alkenyl, S-alkenyl, N(R$_m$)-alkenyl, O-alkynyl, S-alkynyl, N(R$_m$)-alkynyl, O-alkylenyl-O-alkyl, alkynyl, alkaryl, aralkyl, O-alkaryl, O-aralkyl, O(CH$_2$)$_2$SCH$_3$, O(CH$_2$)$_2$ON(R$_m$)(R$_n$) or OCH$_2$C(=O)—N(R$_m$)(R$_n$), where each R$_m$ and R$_n$ is, independently, H, an amino protecting group, or substituted or unsubstituted C$_1$-C$_{10}$ alkyl, —O(CH$_2$)$_2$ON(CH$_3$)$_2$ ("DMAOE"), 2'-OCH$_2$OCH$_2$N(CH$_2$)$_2$ ("DMAEOE"), and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro (NO$_2$), thiol, thioalkoxy, thioalkyl, halogen, alkyl, aryl, alkenyl and alkynyl. In certain embodiments, non-bicyclic modified sugar moieties comprise a substituent group at the 3'-position. Examples of substituent groups suitable for the 3'-position of modified sugar moieties include but are not limited to alkoxy (e.g., methoxy), alkyl (e.g., methyl, ethyl). In certain embodiments, non-bicyclic modified sugar moieties comprise a substituent group at the 4'-position. Examples of 4'-substituent groups suitable for non-bicyclic modified sugar moieties include but are not limited to alkoxy (e.g., methoxy), alkyl, and those described in Manoharan et al., WO 2015/106128. Examples of 5'-substituted groups suitable for non-bicyclic modified sugar moieties include but are not limited to: 5'-methyl (R or S), 5'-vinyl, ethyl, and 5'-methoxy. In certain embodiments, non-bicyclic modified sugar moieties comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836).

In certain embodiments, a 2'-substituted non-bicyclic modified nucleoside comprises a sugar moiety comprising a non-bridging 2'-substituent group selected from: F, $NH_2$, $N_3$, $OCF_3$, $OCH_3$, $O(CH_2)_3NH_2$, $CH_2CH=CH_2$, $OCH_2CH=CH_2$, $OCH_2CH_2OCH_3$, $O(CH_2)_2SCH_3$, $O(CH_2)_2ON(R_m)(R_n)$, $O(CH_2)_2O(CH_2)_2N(CH_3)_2$, and N-substituted acetamide ($OCH_2C(=O)—N(R_m)(R_n)$), where each $R_m$ and $R_n$ is, independently, H, an amino protecting group, or substituted or unsubstituted $C_1$-$C_{10}$ alkyl.

In certain embodiments, a 2'-substituted nucleoside non-bicyclic modified nucleoside comprises a sugar moiety comprising a non-bridging 2'-substituent group selected from: F, $OCF_3$, $OCH_3$, $OCH_2CH_2OCH_3$, $O(CH_2)_2SCH_3$, $O(CH_2)_2ON(CH_3)_2$, $O(CH_2)_2O(CH_2)_2N(CH_3)_2$, $O(CH_2)_2ON(CH_3)_2$ ("DMAOE"), $OCH_2OCH_2N(CH_3)_2$ ("DMAEOE") and $OCH_2C(=O)—N(H)CH_3$ ("NMA").

In certain embodiments, a 2'-substituted non-bicyclic modified nucleoside comprises a sugar moiety comprising a non-bridging 2'-substituent group selected from: F, $OCH_3$, and $OCH_2CH_2OCH_3$.

In naturally occurring nucleic acids, sugars are linked to one another 3' to 5'. In certain embodiments, oligonucleotides include one or more nucleoside or sugar moiety linked at an alternative position, for example at the 2' or inverted 5' to 3'. For example, where the linkage is at the 2' position, the 2'-substituent groups may instead be at the 3'-position.

Certain modified sugar moieties comprise a substituent that bridges two atoms of the furanosyl ring to form a second ring, resulting in a bicyclic sugar moiety. Nucleosides comprising such bicyclic sugar moieties have been referred to as bicyclic nucleosides (BNAs), locked nucleosides, or conformationally restricted nucleotides (CRN). Certain such compounds are described in US Patent Publication No. 2013/0190383; and PCT publication WO 2013/036868. In certain such embodiments, the bicyclic sugar moiety comprises a bridge between the 4' and the 2' furanose ring atoms, n certain such embodiments, the furanose ring is a ribose ring. Examples of such 4' to 2' bridging sugar substituents include but are not limited to: 4'-$CH_2$-2', 4'-$(CH_2)_2$-2', 4'-$(CH_2)_3$-2', 4'-$CH_2$—O-2' ("LNA"), 4'-$CH_2$—S-2', 4'-$(CH_2)_2$—O-2' ("ENA"), 4'-$CH(CH_3)$—O-2' (referred to as "constrained ethyl" or "cEt" when in the S configuration), 4'-$CH_2$—O—$CH_2$-2', 4'-$CH_2$—N(R)-2', 4'-CH($CH_2OCH_3$)—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-$C(CH_3)(CH_3)$—O-2' and analogs thereof (see, e.g, Seth et al., U.S. Pat. No. 8,278,283), 4'-$CH_2$—N($OCH_3$)-2' and analogs thereof (see, e.g., Prakash et al., U.S. Pat. No. 8,278,425), 4'-$CH_2$—O—N($CH_3$)-2' (see, e.g., Allerson et al., U.S. Pat. No. 7,696,345 and Allerson et al., U.S. Pat. No. 8,124,745), 4'-$CH_2$—C(H)($CH_3$)-2' (see, e.g, Zhou, el at, J. Org. Chem., 2009, 74, 118-134), 4'-$CH_2$—C(=$CH_2$)-2' and analogs thereof (see e.g., Seth et al., U.S. Pat. No. 8,278,426), 4'-C($R_aR_b$)—N(R)—O-2', 4'—C($R_aR_b$)—O—N(R)-2', 4'-$CH_2$—O—N(R)-2', and 4'-$CH_2$—N(R)—O-2', wherein each R, $R_a$, and $R_b$ is, independently, H, a protecting group, or $C_1$-$C_{12}$ alkyl (see, e.g. Imanishi et al., U.S. Pat. No. 7,427,672).

In certain embodiments, such 4' to 2' bridges independently comprise from 1 to 4 linked groups independently selected from: —[C(Ra)(Rb)]n-, —[C(Ra)(Rb)]n-O—, C(Ra)=C(Rb)—, C(Ra)=N—, C(=NRa)—, —C(=O)—, —C(=S)—, —O—, —Si(Ra)2-, —S(=O)x-, and N(Ra)—;

wherein:

x is 0, 1, or 2;

n is 1, 2, 3, or 4;

each Ra and Rb is, independently, H, a protecting group, hydroxyl, C1-C12 alkyl, substituted C1-C12 alkyl, C2-C12 alkenyl, substituted C2-C12 alkenyl, C2-C12 alkynyl, substituted C2-C12 alkynyl, C5-C20 aryl, substituted C5-C20 aryl, heterocycle radical, substituted heterocycle radical, heteroaryl, substituted heteroaryl, C5-C7 alicyclic radical, substituted C5-C7 alicyclic radical, halogen, OJ1, NJ1J2, SJ1, N3, COOJ1, acyl (C(=O)—H), substituted acyl, CN, sulfonyl (S(=O) 2-J1), or sulfoxyl (S(=O)-J1); and each J1 and J2 is, independently, H, C1-C12 alkyl, substituted C1-C12 alkyl, C2-C12 alkenyl, substituted C2-C12 alkenyl, C2-C12 alkynyl, substituted C2-C12 alkynyl, C5-C20 aryl, substituted C5-C20 aryl, acyl (C(=O)—H), substituted acyl, a heterocycle radical, a substituted heterocycle radical, C1-C12 aminoalkyl, substituted C1-C12 aminoalkyl, or a protecting group.

Additional bicyclic sugar moieties are known in the art, see, for example: Freier et al., Nucleic Acids Research, 1997, 25(22), 4429-4443, Albaek et al., J. Org. Chem., 2006, 71, 7731-7740, Singh et al., Chem. Commun., 1998, 4, 455-456; Koshkin et al., Tetrahedron, 1998, 54, 3607-3630; Wahlestedt et al., Proc. Natl. Acad. Sci. U.S.A, 2000, 97, 5633-5638; Kumar et al., Bioorg. Med. Chem. Lett., 1998, 8, 2219-2222; Singh et al., J. Org. Chem., 1998, 63, 10035-10039; Srivastava et al., J. Am. Chem. Soc., 2007, 129, 8362-8379; Elayadi et al., Curr. Opinion Invens. Drugs, 2001, 2, 558-561; Braasch et al., Chem. Biol., 2001, 8, 1-7; Omm et al., Curr. Opinion Mol. Ther., 2001, 3, 239-243; Wengel et al., U.S. Pat. No. 7,053,207, Imanishi et al., U.S. Pat. No. 6,268,490, Imanishi et al. U.S. Pat. No. 6,770,748, Imanishi et al., U.S. Pat. No. RE44,779; Wengel et al., U.S. Pat. No. 6,794,499, Wengel et al., U.S. Pat. No. 6,670,461; Wengel et al., U.S. Pat. No. 7,034,133, Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; and Ramasamy et al., U.S. Pat. No. 6,525,191, Torsten et al., WO 2004/106356, Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; Allerson et al., US2008/0039618; and Migawa et al., US2015/0191727. In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

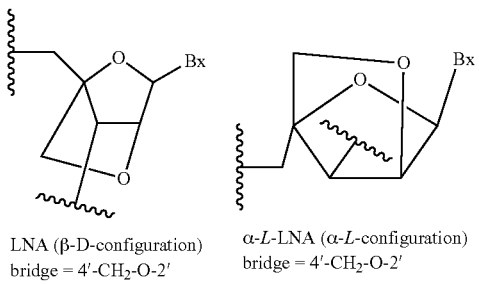

LNA (β-D-configuration)
bridge = 4'-CH$_2$-O-2'

α-L-LNA (α-L-configuration)
bridge = 4'-CH$_2$-O-2'

α-L-methyleneoxy (4'-CH$_2$—O-2') or α-L-LNA bicyclic nucleosides have been incorporated into oligonucleotides that showed antisense activity (Frieden et al., *Nucleic Acids Research*, 2003, 21, 6365-6372). The addition of locked nucleic acids to siRNAs has been shown to increase siRNA stability in serum, and to reduce off-target effects (Elmen, J. et al., (2005) Nucleic Acids Research 33(1): 439-447; Mook, O R. et al., (2007) Mai Cane Ther 6(3):833-843; Grunweller, A. et al., (2003) Nucleic Acids Research 31(12):3185-3193). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see. e.g., Bhat et al., U.S. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see, e.g., Leumann, C J. *Bioorg. & Med. Chem.* 2002, 10, 841-854), fluoro HNA:

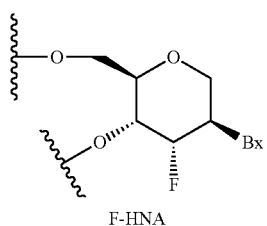

F-HNA ("F-HNA", see e.g. Swayze et al., U.S. Pat. No. 8,088,904; Swayze et al., U.S. Pat. No. 8,440,803; Swayze et al., U.S. Pat. No. 8,796,437; and Swayze et al., U.S. Pat. No. 9,005,906; F-HNA can also be referred to as a F-THP or 3'-fluoro tetrahydropyran), and nucleosides comprising additional modified THP compounds having the formula:

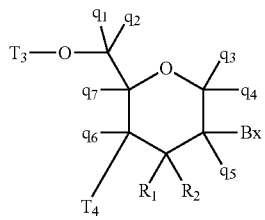

wherein, independently, for each of said modified THP nucleoside:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group;

$q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, NTT. ST, $N_3$, OC(=X)$J_1$, OC(=X)N$J_1J_2$, N$J_3$C(=X)N$J_1J_2$, and CN, wherein X is O, S or N$J_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 47, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

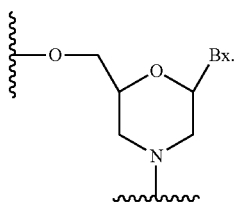

In certain embodiments, morpholinos may be modified, for example by adding or altering various substituent groups from the above morpholino structure. Such sugar surrogates are referred to herein as "modified morpholinos."

In certain embodiments, sugar surrogates comprise acyclic moieties. Examples of nucleosides and oligonucleotides comprising such acyclic sugar surrogates include but are not limited to: peptide nucleic acid ("PNA"), acyclic butyl nucleic acid (see, e.g., Kumar et al., Org. Biomol. Chem., 2013, 11, 5853-5865), and nucleosides and oligonucleotides described in Manoharan et al., WO2011/133876. In certain embodiments, sugar surrogates comprise acyclic moieties. Examples of nucleosides and oligonucleotides comprising such acyclic sugar surrogates include, but are not limited to: peptide nucleic acid ("PNA"), acyclic butyl nucleic acid (see, e.g., Kumar et al., Org. Biomol. Chem., 2013, 11, 5853-5865), and nucleosides and oligonucleotides described in Manoharan et al., US2013/130378. Representative U.S. patents that teach the preparation of PNA compounds include, but are not limited to, U.S. Pat. Nos. 5,539,082; 5,714,331; and 5,719,262. Additional PNA compounds suitable for use in the oligonucleotides of the invention are described in, for example, in Nielsen et al., Science, 1991, 254, 1497-1500.

In certain embodiments, sugar surrogates are the "unlocked" sugar structure of UNA (unlocked nucleic acid) nucleosides. UNA is an unlocked acyclic nucleic acid, wherein any of the bonds of the sugar has been removed, forming an unlocked sugar surrogate. Representative U.S. publications that teach the preparation of UNA include, but are not limited to, U.S. Pat. No. 8,314,227; and US Patent Publication Nos. 2013/0096289; 2013/0011922; and 2011/0313020, the entire contents of each of which are hereby incorporated herein by reference.

In certain embodiments, sugar surrogates are the glycerol as found in GNA (glycol nucleic acid) nucleosides as depicted below:

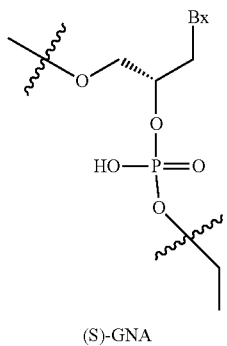

(S)-GNA where Bx represents any nucleobase.

Many other bicyclic and tricyclic sugar and sugar surrogats are known in the art that can be used in modified nucleosides.

2. Certain Modified Nucleobases

In certain embodiments, modified oligonucleotides comprise one or more nucleoside comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside. In certain embodiments, modified oligonucleotides comprise one or more inosine nucleosides (i.e., nucleosides comprising a hypoxanthine nucleobase).

In certain embodiments, modified nucleobases are selected from: 5-substituted pyrimidines, 6-azapyrimidines, alkyl or alkynyl substituted pyrimidines, alkyl substituted purines, and N-2, N-6 and 0-6 substituted purines. In certain embodiments, modified nucleobases are selected from: 5-methylcytosine, 2-aminopropyladenine, 5-hydroxymethyl cytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl (—C≡C—CH$_3$) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in Merigan et al., U.S. Pat. No. 3,687,808, those disclosed in *The Concise Encyclopedia Of Polymer Science And Engineering*, Kroschwitz, J. I., Ed., John Wiley & Sons, 1990, 858-859; Englisch et al., *Angewandte Chemie*, International Edition, 1991, 30, 613; Sanghvi, Y. S., Chapter 15, *Antisense Research and Applications*, Crooke, S. T. and Lebleu, B., Eds., CRC Press, 1993, 273-288; and those disclosed in Chapters 6 and 15, *Antisense Drug Technology*, Crooke S. T., Ed., CRC Press, 2008, 163-166 and 442-443.

Publications that teach the preparation of certain of the above noted modified nucleobases as well as other modified nucleobases include without limitation, Manoharan et al., US2003/0158403; Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., U.S. Pat. No. 6,166,199; and Matteucci et al., U.S. Pat. No. 6,005,096.

3. Certain Modified Internucleoside Linkages

The naturally occurring internucleoside linkage of RNA and DNA is a 3' to 5' phosphodiester linkage. In certain embodiments, nucleosides of modified oligonucleotides may be linked together using one or more modified internucleoside linkages. The two main classes of internucleoside linking groups are defined by the presence or absence of a phosphorus atom. Representative phosphorus-containing internucleoside linkages include but are not limited to phosphates, which contain a phosphodiester bond ("P=O") (also referred to as unmodified or naturally occurring linkages), phosphotriesters, methylphosphonates, phosphoramidates, and phosphorothioates ("P=S"), and phosphorodithioates ("HS—P=S"). Representative non-phosphorus containing internucleoside linking groups include but are not limited to methylenemethylimino (—$CH_2$—$N(CH_3)$—O—$CH_2$—), thiodiester, thionocarbamate (—O—C(=O)(NH)—S—); siloxane (—O—$SiH_2$—O—); and N,N'-dimethylhydrazine (—$CH_2$—$N(CH_3)$—$N(CH_3)$—). Modified internucleoside linkages, compared to naturally occurring phosphate linkages, can be used to alter, typically increase, nuclease resistance of the oligonucleotide. In certain embodiments, internucleoside linkages having a chiral atom can be prepared as a racemic mixture, or as separate enantiomers. Methods of preparation of phosphorous-containing and non-phosphorous-containing internucleoside linkages are well known to those skilled in the art.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate linkage. Nonetheless, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkages in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of modified oligonucleotides can be generated using synthetic methods known in the art, e.g., methods described in Oka et al., JACS 125, 8307 (2003), Wan et al. Nuc. Acid. Res. 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (S'p) phosphorothioates comprise one or more of the following formulas, respectively, wherein "B" indicates a nucleobase:

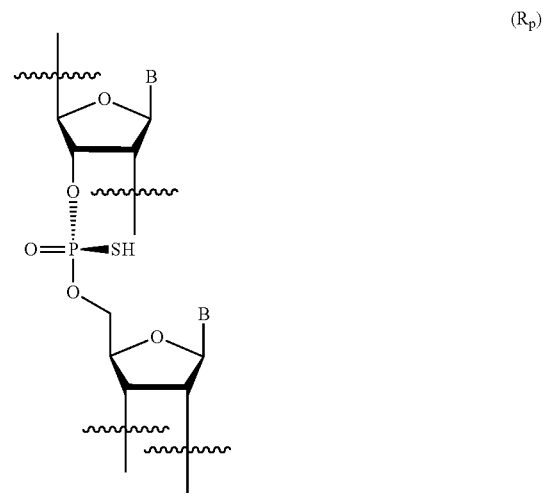

(Rp)

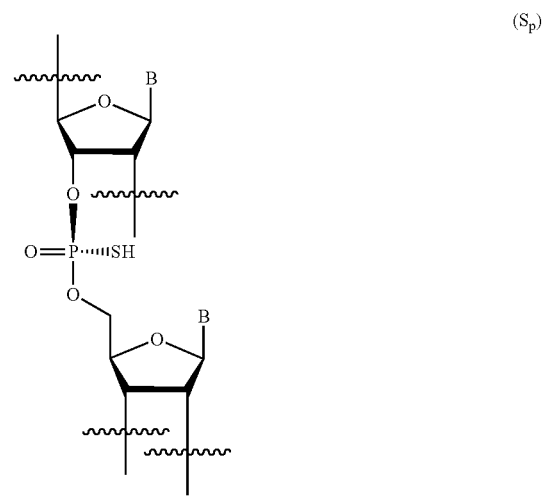

(Sp)

Unless otherwise indicated, chiral internucleoside linkages of modified oligonucleotides described herein can be stereorandom or in a particular stereochemical configuration.

Neutral internucleoside linkages include, without limitation, phosphotriesters, methylphosphonates, MMI (3'-$CH_2$—$N(CH_3)$—O-5'), amide-3 (3'-$CH_2$—C(=O)—N(H)-5'), amide-4 (3'-$CH_2$—N(H)—C(=O)-5'), formacetal (3'-O—$CH_2$—O-5'), methoxypropyl (MOP), and thioformacetal (3'-S—$CH_2$—O-5'). Further neutral internucleoside linkages include nonionic linkages comprising siloxane (dialkylsiloxane), carboxylate ester, carboxamide, sulfide, sulfonate ester and amides (See for example: Carbohydrate Modifications in Antisense Research; Y. S. Sanghvi and P. D. Cook, Eds., ACS Symposium Series 580;

Chapters 3 and 4, 40-65). Further neutral internucleoside linkages include nonionic linkages comprising mixed N, O, S and $CH_2$ component parts.

In certain embodiments, modified oligonucleotides comprise one or more inverted nucleoside, as shown below:

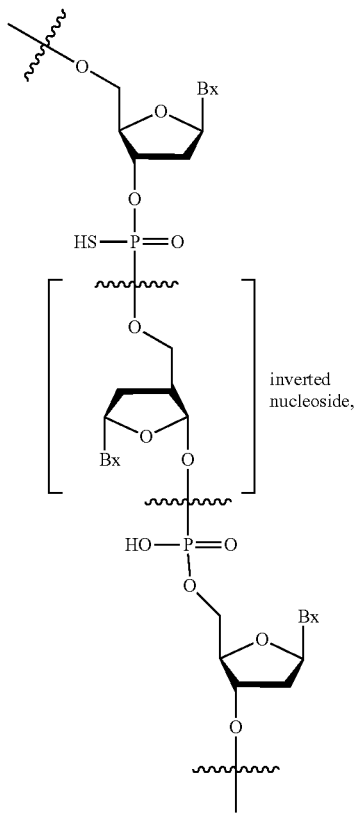

wherein each Bx independently represents any nucleobase.

In certain embodiments, an inverted nucleoside is terminal (i.e., the last nucleoside on one end of an oligonucleotide) and so only one internucleoside linkage depicted above will be present. In certain such embodiments, additional features (such as a conjugate group) may be attached to the inverted nucleoside. Such terminal inverted nucleosides can be attached to either or both ends of an oligonucleotide.

In certain embodiments, such groups lack a nucleobase and are referred to herein as inverted sugar moieties. In certain embodiments, an inverted sugar moiety is terminal (i.e., attached to the last nucleoside on one end of an oligonucleotide) and so only one internucleoside linkage above will be present. In certain such embodiments, additional features (such as a conjugate group) may be attached to the inverted sugar moiety. Such terminal inverted sugar moieties can be attached to either or both ends of an oligonucleotide.

In certain embodiments, nucleic acids can be linked 2' to 5' rather than the standard 3' to 5' linkage. Such a linkage is illustrated below:

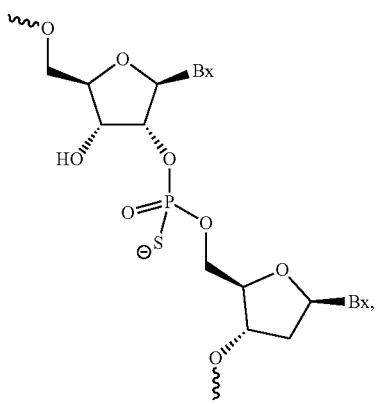

wherein each Bx represents any nucleobase.

B. Certain Motifs

In certain embodiments, modified oligonucleotides comprise one or more modified nucleosides comprising a modified sugar moiety. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

1. Certain Sugar Motifs

In certain embodiments, oligonucleotides comprise one or more type of modified sugar and/or unmodified sugar moiety arranged along the oligonucleotide or region thereof in a defined pattern or sugar motif. In certain instances, such sugar motifs include but are not limited to any of the sugar modifications discussed herein.

Uniformly Modified Oligonucleotides

In certain embodiments, modified oligonucleotides comprise or consist of a region having a fully modified sugar motif. In such embodiments, each nucleoside of the fully modified region of the modified oligonucleotide comprises a modified sugar moiety. In certain embodiments, each nucleoside of the entire modified oligonucleotide comprises a modified sugar moiety. In certain embodiments, modified oligonucleotides comprise or consist of a region having a fully modified sugar motif, wherein each nucleoside within the fully modified region comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified nucleotide comprises the same 2'-modification.

Gapmer Oligonucleotides

In certain embodiments, modified oligonucleotides comprise or consist of a region having a gapmer motif, which is defined by two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer).

In certain embodiments, the wings of a gapmer comprise 1-6 nucleosides. In certain embodiments, each nucleoside of each wing of a gapmer comprises a modified sugar moiety. In certain embodiments, at least one nucleoside of each wing of a gapmer comprises a modified sugar moiety. In certain embodiments, at least two nucleosides of each wing of a gapmer comprises a modified sugar moiety. In certain embodiments, at least three nucleosides of each wing of a gapmer comprises a modified sugar moiety. In certain embodiments, at least four nucleosides of each wing of a gapmer comprises a modified sugar moiety.

In certain embodiments, the gap of a gapmer comprises 7-12 nucleosides. In certain embodiments, each nucleoside of the gap of a gapmer comprises a 2'-β-D-deoxyribosyl sugar moiety. In certain embodiments, at least one nucleoside of the gap of a gapmer comprises a modified sugar moiety.

In certain embodiments, the gapmer is a deoxy gapmer. In certain embodiments, the nucleosides on the gap side of each wing/gap junction comprise 2'-deoxyribosyl sugar moieties and the nucleosides on the wing sides of each wing/gap junction comprise modified sugar moieties. In certain embodiments, each nucleoside of the gap comprises a 2'-β-D-deoxyribosyl sugar moiety. In certain embodiments, each nucleoside of each wing of a gapmer comprises a modified sugar moiety. In certain embodiments, at least one nucleoside of the gap of a gapmer comprises a modified sugar moiety. In certain embodiments, at least one nucleoside of the gap of a gapmer comprises a 2'-OMe sugar moiety.

Herein, the lengths (number of nucleosides) of the three regions of a gapmer may be provided using the notation [# of nucleosides in the 5'-wing]-[# of nucleosides in the gap]-[# of nucleosides in the 3'-wing]. Thus, a 3-10-3 gapmer consists of 3 linked nucleosides in each wing and 10 linked nucleosides in the gap. Where such nomenclature is followed by a specific modification, that modification is the modification in each sugar moiety of each wing and the gap nucleosides comprise 2'-β-D-deoxyribosyl sugar moieties. Thus, a 5-10-5 MOE gapmer consists of 5 linked 2'-MOE nucleosides in the 5'-wing, 10 linked 2'-β-D-deoxynucleosides in the gap, and 5 linked 2'-MOE nucleosides in the 3'-wing. A 3-10-3 cEt gapmer consists of 3 linked cEt nucleosides in the 5'-wing, 10 linked 2'-β-D-deoxynucleosides in the gap, and 3 linked cEt nucleosides in the 3'-wing. A 5-8-5 gapmer consists of 5 linked nucleosides comprising a modified sugar moiety in the 5'-wing, 8 linked 2'-β-D-deoxynucleosides in the gap, and 5 linked nucleosides comprising a modified sugar moiety in the 3'-wing. A 5-8-5 mixed gapmer has at least two different modified sugar moieties in the 5'- and/or the 3'-wing.

In certain embodiments, modified oligonucleotides are 5-10-5 MOE gapmers. In certain embodiments, modified oligonucleotides are 3-10-3 BNA gapmers. In certain embodiments, modified oligonucleotides are 3-10-3 cEt gapmers. In certain embodiments, modified oligonucleotides are 3-10-3 LNA gapmers.

In certain embodiments, modified oligonucleotides are 5-8-5 mixed gapmers that consist of 5 linked 2'-MOE nucleosides in the 5'-wing, 8 linked 2'-β-D-deoxynucleosides in the gap, and a mixture of cEt and 2'-MOE nucleosides in the 3'-wing. In certain embodiments, modified nucleosides have a sugar motif of eeeeedddddddddkkeee, where each "e" represents a nucleoside comprising a 2'-MOE modified sugar moiety, each "d" represents a nucleoside comprising a 2'-β-D-deoxyribosyl sugar moiety, and each "k" represents a nucleoside comprising a cEt modified sugar moiety. In certain embodiments, modified nucleosides have a sugar motif of eeeeedddddddddkeeee, where each "e" represents a nucleoside comprising a 2'-MOE modified sugar moiety, each "d" represents a nucleoside comprising a 2'-β-D-deoxyribosyl sugar moiety, and each "k" represents a nucleoside comprising a cEt modified sugar moiety.

2. Certain Nucleobase Motifs

In certain embodiments, oligonucleotides comprise modified and/or unmodified nucleobases arranged along the oligonucleotide or region thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methyl cytosines. In certain embodiments, all of the cytosine nucleobases are 5-methyl cytosines and all of the other nucleobases of the modified oligonucleotide are unmodified nucleobases.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-deoxyribosyl sugar moiety. In certain embodiments, the modified nucleobase is selected from: a 2-thiopyrimidine and a 5-propynepyrimidine.

3. Certain Internucleoside Linkage Motifs

In certain embodiments, oligonucleotides comprise modified and/or unmodified internucleoside linkages arranged along the oligonucleotide or region thereof in a defined pattern or motif. In certain embodiments, each internucleoside linking group is a phosphodiester internucleoside linkage (P=O). In certain embodiments, each internucleoside linking group of a modified oligonucleotide is a phosphorothioate internucleoside linkage (P=S). In certain embodiments, each internucleoside linkage of a modified oligonucleotide is independently selected from a phosphorothioate internucleoside linkage and phosphodiester internucleoside linkage. In certain embodiments, each phosphorothioate internucleoside linkage is independently selected from a stereorandom phosphorothioate a (Sp) phosphorothioate, and a (Rp) phosphorothioate.

In certain embodiments, the sugar motif of a modified oligonucleotide is a gapmer and the internucleoside linkages within the gap are all modified. In certain such embodiments, some or all of the internucleoside linkages in the wings are unmodified phosphodiester internucleoside linkages. In certain embodiments, the terminal internucleoside linkages are modified. In certain embodiments, the sugar motif of a modified oligonucleotide is a gapmer, and the internucleoside linkage motif comprises at least one phosphodiester internucleoside linkage in at least one wing, wherein the at least one phosphodiester linkage is not a terminal internucleoside linkage, and the remaining internucleoside linkages are phosphorothioate internucleoside linkages. In certain such embodiments, all of the phosphorothioate linkages are stereorandom. In certain embodiments, all of the phosphorothioate linkages in the wings are (Sp) phosphorothioates, and the gap comprises at least one Sp, Sp, Rp motif. In certain embodiments, populations of modified oligonucleotides are enriched for modified oligonucleotides comprising such internucleoside linkage motifs.

In certain embodiments, modified nucleotides have an internucleoside linkage motif of soossssssssssos, wherein each "s" represents a phosphorothioate internucleoside linkage and each "o" represents a phosphate internucleoside linkage. In certain embodiments, modified nucleotides have an internucleoside linkage motif of sooooossssssssssoss, wherein each "s" represents a phosphorothioate internucleoside linkage and each "o" represents a phosphate internucleoside linkage. In certain embodiments, modified nucleotides have an internucleoside linkage motif of sooossssssssssssooss, wherein each "s" represents a phosphorothioate internucleoside linkage and each "o" represents a phosphate internucleoside linkage. In certain embodiments, modified nucleotides have an internucleoside linkage motif of soooosssssssssssoss, wherein each "s" represents a phosphorothioate internucleoside linkage and each "o" represents a phosphate internucleoside linkage. In certain embodiments, modified nucleotides have an internucleoside linkage motif of ssooossssssssssoooss, wherein each "s" represents a phosphorothioate internucleoside linkage and each "o" represents a phosphate internucleoside linkage. In certain embodiments, modified nucleotides have an internucleoside linkage motif of sooossssssssssssooos, wherein each "s" represents a phosphorothioate internucleoside linkage and each "o" represents a phosphate internucleoside linkage.

C. Certain Lengths

It is possible to increase or decrease the length of an oligonucleotide without eliminating activity. For example, in Woolf et al. (Proc. Natl. Acad. Sci. USA 89:7305-7309, 1992), a series of oligonucleotides 13-25 nucleobases in length were tested for their ability to induce cleavage of a target RNA in an oocyte injection model. Oligonucleotides 25 nucleobases in length with 8 or 11 mismatch bases near the ends of the oligonucleotides were able to direct specific cleavage of the target RNA, albeit to a lesser extent than the oligonucleotides that contained no mismatches. Similarly, target specific cleavage was achieved using 13 nucleobase oligonucleotides, including those with 1 or 3 mismatches.

In certain embodiments, oligonucleotides (including modified oligonucleotides) can have any of a variety of ranges of lengths. In certain embodiments, oligonucleotides consist of X to Y linked nucleosides, where X represents the fewest number of nucleosides in the range and Y represents the largest number nucleosides in the range. In certain such embodiments, X and Y are each independently selected from 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50; provided that X≤Y. For example, in certain embodiments, oligonucleotides consist of 12 to 13, 12 to 14, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 14, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 29, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to 30, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 linked nucleosides.

D. Certain Modified Oligonucleotides

In certain embodiments, the above modifications (sugar, nucleobase, internucleoside linkage) are incorporated into a modified oligonucleotide. In certain embodiments, modified oligonucleotides are characterized by their modification motifs and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such sugar gapmer oligonucleotides may comprise one or more modified nucleobase independent of the gapmer pattern of the sugar modifications. Unless otherwise indicated, all modifications are independent of nucleobase sequence.

E. Certain Populations of Modified Oligonucleotides

Populations of modified oligonucleotides in which all of the modified oligonucleotides of the population have the same molecular formula can be stereorandom populations or chirally enriched populations. All of the chiral centers of all of the modified oligonucleotides are stereorandom in a stereorandom population. In a chirally enriched population, at least one particular chiral center is not stereorandom in the modified oligonucleotides of the population. In certain embodiments, the modified oligonucleotides of a chirally enriched population are enriched for β-D ribosyl sugar moieties, and all of the phosphorothioate internucleoside linkages are stereorandom. In certain embodiments, the modified oligonucleotides of a chirally enriched population are enriched for both β-D ribosyl sugar moieties and at least one, particular phosphorothioate internucleoside linkage in a particular stereochemical configuration.

F. Nucleobase Sequence

In certain embodiments, oligonucleotides (unmodified or modified oligonucleotides) are further described by their nucleobase sequence. In certain embodiments oligonucleotides have a nucleobase sequence that is complementary to a second oligonucleotide or an identified reference nucleic acid, such as a target nucleic acid. In certain such embodiments, a region of an oligonucleotide has a nucleobase sequence that is complementary to a second oligonucleotide or an identified reference nucleic acid, such as a target nucleic acid. In certain embodiments, the nucleobase sequence of a region or entire length of an oligonucleotide is at least 50%, at least 60%, at least 70%, at least 80%, at least 85%, at least 90%, at least 95%, or 100% complementary to the second oligonucleotide or nucleic acid, such as a target nucleic acid.

II. Certain Oligomeric Compounds

In certain embodiments, provided herein are oligomeric compounds, which consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

Examples of terminal groups include but are not limited to conjugate groups, capping groups, phosphate moieties, protecting groups, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance.

In certain embodiments, conjugation of one or more carbohydrate moieties to a modified oligonucleotide can optimize one or more properties of the modified oligonucleotide. In certain embodiments, the carbohydrate moiety is attached to a modified subunit of the modified oligonucleotide. For example, the ribose sugar of one or more ribonucleotide subunits of a modified oligonucleotide can be replaced with another moiety, e.g. a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS), which is a modified sugar moiety. A cyclic carrier may be a carbocyclic ring system, i.e., one or more ring atoms may be a heteroatom, e.g., nitrogen, oxygen, sulphur. The cyclic carrier may be a monocyclic ring system, or may contain two or more rings, e.g. fused rings. The cyclic carrier may be a fully saturated ring system, or it may contain one or more double bonds. In certain embodiments, the modified oligonucleotide is a gapmer.

In certain embodiments, conjugate groups impart a new property on the attached oligonucleotide, e.g., fluorophores or reporter groups that enable detection of the oligonucleotide. Certain conjugate groups and conjugate moieties have been described previously, for example: cholesterol moiety (Letsinger et al., Proc. Natl. Acad. Sci. USA, 1989, 86, 6553-6556), cholic acid (Manoharan et al., *Bioorg. Med. Chem. Lett.,* 1994, 4, 1053-1060), a thioether, e.g., hexyl-S-tritylthiol (Manoharan et al., *Ann. N.Y. Acad. Sci.,* 1992, 660, 306-309; Manoharan et al., *Bioorg. Med. Chem. Lett.,* 1993, 3, 2765-2770), a thiocholesterol (Oberhauser et al., *Nucl. Acids Res.,* 1992, 20, 533-538), an aliphatic chain, e.g., do-decan-diol or undecyl residues (Saison-Behmoaras et al., *EMBO J,* 1991, 10, 1111-1118: Kabanov et al., *FEBS Lett.,* 1990, 259, 327-330; Svinarchuk et al., *Biochimie,* 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., *Tetrahedron Lett.,* 1995, 36, 3651-3654; Shea et al., *Nucl. Acids Res.,* 1990, 18, 3777-3783), a polyamine or a polyethylene glycol chain (Manoharan et al., *Nucleosides & Nucleotides,* 1995, 14, 969-973), or adamantane acetic acid a palmityl moiety (Mishra et al., *Biochim. Biophys. Acta,* 1995, 1264, 229-237), an octadecylamine or hexylamino-carbonyl-oxycholesterol moiety (Crooke et al., *J. Pharmacol. Exp. Ther.,* 1996, 277, 923-937), a tocopherol group (Nishina et al., *Molecular Therapy Nucleic Acids,* 2015, 4, e220; and Nishina et al., *Molecular Therapy,* 2008, 16, 734-740), or a GalNAc cluster (e.g., WO2014/179620).

In certain embodiments, conjugate groups may be selected from any of a C22 alkyl, C20 alkyl, C16 alkyl, C10 alkyl, C21 alkyl, C19 alkyl, C18 alkyl, C15 alkyl, C14 alkyl, C13 alkyl, C12 alkyl, C11 alkyl, C9 alkyl, C8 alkyl, C7 alkyl, C6 alkyl, C5 alkyl, C22 alkenyl, C20 alkenyl, C16 alkenyl, C10 alkenyl, C21 alkenyl, C19 alkenyl, C18 alkenyl, C15 alkenyl, C14 alkenyl, C13 alkenyl, C12 alkenyl, C11 alkenyl, C9 alkenyl, C8 alkenyl, C7 alkenyl, C6 alkenyl, or C5 alkenyl.

In certain embodiments, conjugate groups may be selected from any of C22 alkyl, C20 alkyl, C16 alkyl, C10 alkyl, C21 alkyl, C19 alkyl, C18 alkyl, C15 alkyl, C14 alkyl, C13 alkyl, C12 alkyl, C11 alkyl, C9 alkyl, C8 alkyl, C7 alkyl, C6 alkyl, and C5 alkyl, where the alkyl chain has one or more unsaturated bonds.

1. Conjugate Moieties

Conjugate moieties include, without limitation, intercalators, reporter molecules, polyamines, polyamides, peptides, carbohydrates (e.g., GalNAc), vitamin moieties, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain oligomeric compounds, the conjugate linker is a single chemical bond (i.e., the conjugate moiety is attached directly to an oligonucleotide through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises pyrrolidine.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to compounds, such as the oligonucleotides provided herein. In general, a bifunctional linking moiety comprises at least two functional groups. One of the functional groups is selected to bind to a particular site on a compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, conjugate linkers comprise 2-5 linker-nucleosides. In certain embodiments, conjugate linkers comprise exactly 3 linker-nucleosides. In certain embodiments, conjugate linkers comprise the TCA motif. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methyl cytosine, 4-N-benzoyl-5-methyl cytosine, adenine, 6-N-benzoyladenine, guanine and 2-N-isobutyrylguanine. It is typically desirable for linker-nucleosides to be cleaved from the oligomeric compound after it reaches a target tissue. Accordingly, linker-nucleosides are typically linked to one another and to the remainder of the oligomeric compound through cleavable bonds. In certain embodiments, such cleavable bonds are phosphodiester bonds.

Herein, linker-nucleosides are not considered to be part of the oligonucleotide. Accordingly, in embodiments in which an oligomeric compound comprises an oligonucleotide consisting of a specified number or range of linked nucleosides and/or a specified percent complementarity to a reference nucleic acid and the oligomeric compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, an oligomeric compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such an oligomeric compound is more than 30. Alternatively, an oligomeric compound may comprise a modified oligonucleotide consisting of 8-30 nucleosides and no conjugate group. The total number of contiguous linked nucleosides in such an oligomeric compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances oligomeric compounds comprising a particular conjugate moiety are better taken up by a particular cell type, but once the oligomeric compound has been taken up, it is desirable that the conjugate group be cleaved to release the unconjugated or parent oligonucleotide. Thus, certain conjugate linkers may comprise one or more cleavable moieties. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester.

In certain embodiments, the cleavable moiety is a phosphate linkage between an oligonucleotide and a conjugate moiety or conjugate group.

In certain embodiments, a cleavable moiety comprises or consists of one or more linker-nucleosides. In certain such embodiments, the one or more linker-nucleosides are linked to one another and/or to the remainder of the oligomeric compound through cleavable bonds. In certain embodiments, such cleavable bonds are unmodified phosphodiester bonds. In certain embodiments, a cleavable moiety is 2'-deoxynucleoside that is attached to either the 3' or 5'-terminal nucleoside of an oligonucleotide by a phosphate internucleoside linkage and covalently attached to the remainder of the conjugate linker or conjugate moiety by a phosphate or phosphorothioate linkage. In certain such embodiments, the cleavable moiety is 2'-deoxyadenosine.

3. Cell-Targeting Moieties

In certain embodiments, a conjugate group comprises a cell-targeting moiety. In certain embodiments, a conjugate group has the general formula:

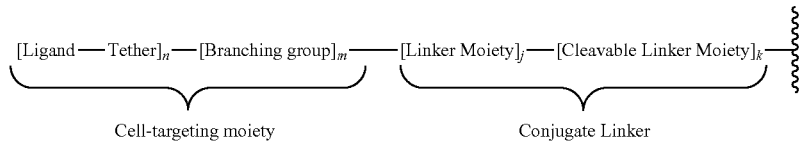

wherein n is from 1 to about 3, m is 0 when n is 1, m is 1 when n is 2 or greater, j is 1 or 0, and k is 1 or 0.

In certain embodiments, n is 1, j is 1 and k is 0. In certain embodiments, n is 1, j is 0 and k is 1. In certain embodiments, n is 1, j is 1 and k is 1. In certain embodiments, n is 2, j is 1 and k is 0. In certain embodiments, n is 2, j is 0 and k is 1. In certain embodiments, n is 2, j is 1 and k is 1. In certain embodiments, n is 3, j is 1 and k is 0. In certain embodiments, n is 3, j is 0 and k is 1. In certain embodiments, n is 3, j is 1 and k is 1.

In certain embodiments, conjugate groups comprise cell-targeting moieties that have at least one tethered ligand. In certain embodiments, cell-targeting moieties comprise two tethered ligands covalently attached to a branching group. In certain embodiments, cell-targeting moieties comprise three tethered ligands covalently attached to a branching group.

In certain embodiments, each ligand of a cell-targeting moiety has an affinity for at least one type of receptor on a target cell. In certain embodiments, each ligand has an affinity for at least one type of receptor on the surface of a mammalian liver cell. In certain embodiments, each ligand has an affinity for the hepatic asialoglycoprotein receptor (ASGP-R). In certain embodiments, each ligand is a carbohydrate.

In certain embodiments, the cell-targeting moiety targets neurons. In certain embodiments, the cell-targeting moiety targets a neurotransmitter receptor. In certain embodiments, the cell targeting moiety targets a neurotransmitter transporter. In certain embodiments, the cell targeting moiety targets a GABA transporter. See e.g., WO 2011/131693, WO 2014/064257.

B. Certain Terminal Groups

In certain embodiments, oligomeric compounds comprise one or more terminal groups. In certain such embodiments, oligomeric compounds comprise a stabilized 5'-phosphate. Stabilized 5'-phosphates include, but are not limited to 5'-phosphonates, including, but not limited to 5'-vinylphosphonates. In certain embodiments, terminal groups comprise one or more abasic sugar moieties and/or inverted nucleosides. In certain embodiments, terminal groups comprise one or more 2'-linked nucleosides or sugar moieties. In certain such embodiments, the 2'-linked group is an abasic sugar moiety.

III. Antisense Activity

In certain embodiments, oligomeric compounds and oligomeric duplexes are capable of hybridizing to a target nucleic acid, resulting in at least one antisense activity; such oligomeric compounds and oligomeric duplexes are antisense compounds. In certain embodiments, antisense compounds have antisense activity when they reduce or inhibit the amount or activity of a target nucleic acid by 25% or more in the standard cell assay. In certain embodiments, antisense compounds selectively affect one or more target nucleic acid. Such antisense compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in significant undesired antisense activity.

In certain antisense activities, hybridization of an antisense compound to a target nucleic acid results in recruitment of a protein that cleaves the target nucleic acid. For example, certain antisense compounds result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, described herein are antisense compounds that are sufficiently "DNA-like" to elicit RNase H activity. In certain embodiments, one or more non-DNA-like nucleoside in the gap of a gapmer is tolerated.

In certain antisense activities, an antisense compound or a portion of an antisense compound is loaded into an RNA-induced silencing complex (RISC), ultimately resulting in cleavage of the target nucleic acid. For example, certain antisense compounds result in cleavage of the target nucleic acid by Argonaute. Antisense compounds that are loaded into RISC are RNAi compounds. RNAi compounds may be double-stranded (siRNA or dsRNAi) or single-stranded (ssRNA).

In certain embodiments, hybridization of an antisense compound to a target nucleic acid does not result in recruitment of a protein that cleaves that target nucleic acid. In certain embodiments, hybridization of the antisense compound to the target nucleic acid results in alteration of splicing of the target nucleic acid. In certain embodiments, hybridization of an antisense compound to a target nucleic acid results in inhibition of a binding interaction between the target nucleic acid and a protein or other nucleic acid. In certain embodiments, hybridization of an antisense compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein and/or a phenotypic change in a cell or animal.

IV. Certain Target Nucleic Acids

In certain embodiments, oligomeric compounds comprise or consist of an oligonucleotide comprising a region that is complementary to a target nucleic acid. In certain embodiments, the target nucleic acid is an endogenous RNA molecule. In certain embodiments, the target nucleic acid encodes a protein. In certain such embodiments, the target nucleic acid is selected from: a mature mRNA and a pre-mRNA, including intronic, exonic and untranslated regions. In certain embodiments, the target RNA is a mature mRNA. In certain embodiments, the target nucleic acid is a pre-mRNA. In certain embodiments, the target region is entirely within an intron. In certain embodiments, the target region spans an intron/exon junction. In certain embodiments, the target region is at least 50% within an intron. In certain embodiments, the target nucleic acid is the RNA transcriptional product of a retrogene. In certain embodiments, the target nucleic acid is a non-coding RNA. In certain embodiments, the target non-coding RNA is selected from: a long non-coding RNA, a short non-coding RNA, an intronic RNA molecule.

A. Complementarity/Mismatches to the Target Nucleic Acid and Duplex Complementarity In certain embodiments, oligonucleotides are complementary to the target nucleic acid over the entire length of the oligonucleotide. In certain embodiments, oligonucleotides are 99%, 95%, 90%, 85%, or 80% complementary to the target nucleic acid. In certain embodiments, oligonucleotides are at least 80% complementary to the target nucleic acid over the entire length of the oligonucleotide and comprise a region that is 100% or fully complementary to a target nucleic acid. In certain embodiments, the region of full complementarity is from 6 to 20, 10 to 18, or 18 to 20 nucleobases in length.

It is possible to introduce mismatch bases without eliminating activity. For example, Gautschi et al (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo. Maher and Dolnick (Nuc. Acid. Res. 16:3341-3358, 1988) tested a series of tandem 14 nucleobase oligonucleotides, and 28 and 42 nucleobase oligonucleotides comprised of the sequence of two or three of the tandem oligonucleotides, respectively, for their ability to arrest translation of human DHFR in a rabbit reticulocyte assay. Each of the three 14 nucleobase oligonucleotides alone was able to inhibit translation, albeit at a more modest level than the 28 or 42 nucleobase oligonucleotides.

In certain embodiments, oligonucleotides comprise one or more mismatched nucleobases relative to the target nucleic acid. In certain embodiments, antisense activity against the target is reduced by such mismatch, but activity against a non-target is reduced by a greater amount. Thus, in certain embodiments selectivity of the oligonucleotide is improved. In certain embodiments, the mismatch is specifically positioned within an oligonucleotide having a gapmer motif. In certain embodiments, the mismatch is at position 1, 2, 3, 4, 5, 6, 7, or 8 from the 5'-end of the gap region. In certain embodiments, the mismatch is at position 9, 8, 7, 6, 5, 4, 3, 2, 1 from the 3'-end of the gap region. In certain embodiments, the mismatch is at position 1, 2, 3, or 4 from the 5'-end of the wing region. In certain embodiments, the mismatch is at position 4, 3, 2, or 1 from the 3'-end of the wing region.

B. APP

In certain embodiments, oligomeric compounds comprise or consist of an oligonucleotide comprising a region that is complementary to a target nucleic acid, wherein the target nucleic acid is APP. In certain embodiments, APP nucleic acid has the sequence set forth SEQ ID NO: 1 (the cDNA of Ensembl transcript ENST00000346798.7 from version 94: October 2018) or the complement of SEQ ID NO: 2 (GENBANK Accession No. NC_000021.9 truncated from nucleotides 25878001 to 26174000). In certain embodiments, APP nucleic acid has the sequence set forth in any of known splice variants of APP, including but not limited to SEQ ID NO: 3 (the cDNA of Ensembl transcript ENST00000357903.7 from version 94: October 2018), SEQ ID NO: 4 (the cDNA of Ensembl transcript ENST00000348990.9 from version 94: October 2018), SEQ ID NO: 5 (the cDNA of Ensembl transcript ENST00000440126.7 from version 94: October 2018), SEQ ID NO: 6 (the cDNA of Ensembl transcript ENST00000354192.7 from version 94: October 2018), SEQ ID NO: 7 (the cDNA of Ensembl transcript ENST00000358918.7 from version 94: October 2018), and/or SEQ ID NO: 8 (GENBANK Accession No. NM_201414.2). In certain embodiments, contacting a cell with an oligomeric compound complementary to SEQ ID NO: 1, SEQ ID NO: 2, SEQ ID NO: 3, SEQ ID NO: 4, SEQ ID NO: 5, SEQ ID NO: 6, SEQ ID NO: 7, or SEQ ID NO: 8 reduces the amount of APP RNA, and in certain embodiments reduces the amount of APP protein. In certain embodiments, the oligomeric compound consists of a modified oligonucleotide. In certain embodiments, contacting a cell with an oligomeric compound complementary to SEQ ID NO: 1, SEQ ID NO: 2, SEQ ID NO: 3, SEQ ID NO: 4, SEQ ID NO: 5, SEQ ID NO: 6, SEQ ID NO: 7, or SEQ ID NO: 8 results in reduced aggregation of β-amyloid. In certain embodiments, the oligomeric compound consists of a modified oligonucleotide. In certain embodiments, the oligomeric compound consists of a modified oligonucleotide and a conjugate group.

C. Certain Target Nucleic Acids in Certain Tissues

In certain embodiments, oligomeric compounds comprise or consist of an oligonucleotide comprising a region that is complementary to a target nucleic acid, wherein the target nucleic acid is expressed in a pharmacologically relevant tissue. In certain embodiments, the pharmacologically relevant tissues are the cells and tissues that comprise the central nervous system. Such tissues include the cortex, and the hippocampus. Such cells include cortical brain cells, hippocampal cells. In certain embodiments, such cells include cells within the limbic system, for example, cells within the hippocampus, the amygdala, and/or parahippocampal gyrus.

V. Certain Pharmaceutical Compositions

In certain embodiments, described herein are pharmaceutical compositions comprising one or more oligomeric compounds. In certain embodiments, the one or more oligomeric compounds each consists of a modified oligonucleotide. In certain embodiments, the pharmaceutical composition comprises a pharmaceutically acceptable diluent or carrier. In certain embodiments, a pharmaceutical composition comprises or consists of a sterile saline solution and one or more oligomeric compound. In certain embodiments, the sterile saline is pharmaceutical grade saline. In certain embodiments, a pharmaceutical composition comprises or consists of one or more oligomeric compound and sterile water. In certain embodiments, the sterile water is pharmaceutical grade water. In certain embodiments, a pharmaceutical composition comprises or consists of one or more oligomeric compound and phosphate-buffered saline (PBS). In certain embodiments, the sterile PBS is pharmaceutical grade PBS. In certain embodiments, a pharmaceutical composition comprises or consists of one or more oligomeric compound and artificial cerebrospinal fluid. In certain embodiments, the artificial cerebrospinal fluid is pharmaceutical grade.

In certain embodiments, a pharmaceutical composition comprises a modified oligonucleotide and artificial cerebrospinal fluid. In certain embodiments, a pharmaceutical composition consists of a modified oligonucleotide and artificial cerebrospinal fluid. In certain embodiments, a pharmaceutical composition consists essentially of a modified oligonucleotide and artificial cerebrospinal fluid. In certain embodiments, the artificial cerebrospinal fluid is pharmaceutical grade.

In certain embodiments, pharmaceutical compositions comprise one or more oligomeric compound and one or more excipients. In certain embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In certain embodiments, oligomeric compounds may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease or disorder, or dose to be administered.

In certain embodiments, pharmaceutical compositions comprising an oligomeric compound encompass any pharmaceutically acceptable salts of the oligomeric compound, esters of the oligomeric compound, or salts of such esters. In certain embodiments, pharmaceutical compositions comprising oligomeric compounds comprising one or more oligonucleotide, upon administration to an animal, including a human, are capable of providing (directly or indirectly) the biologically active metabolite or residue thereof. Accordingly, for example, the disclosure is also drawn to pharmaceutically acceptable salts of oligomeric compounds, prodrugs, pharmaceutically acceptable salts of such prodrugs, and other bioequivalents. Suitable pharmaceutically acceptable salts include, but are not limited to, sodium and potassium salts. In certain embodiments, prodrugs comprise one or more conjugate group attached to an oligonucleotide, wherein the conjugate group is cleaved by endogenous nucleases within the body.

Lipid moieties have been used in nucleic acid therapies in a variety of methods. In certain such methods, the nucleic acid, such as an oligomeric compound, is introduced into preformed liposomes or lipoplexes made of mixtures of cationic lipids and neutral lipids. In certain methods, DNA complexes with mono- or poly-cationic lipids are formed without the presence of a neutral lipid. In certain embodiments, a lipid moiety is selected to increase distribution of a pharmaceutical agent to a particular cell or tissue. In certain embodiments, a lipid moiety is selected to increase distribution of a pharmaceutical agent to fat tissue. In certain embodiments, a lipid moiety is selected to increase distribution of a pharmaceutical agent to muscle tissue.

In certain embodiments, pharmaceutical compositions comprise a delivery system. Examples of delivery systems include, but are not limited to, liposomes and emulsions. Certain delivery systems are useful for preparing certain pharmaceutical compositions including those comprising hydrophobic compounds. In certain embodiments, certain organic solvents such as dimethylsulfoxide are used.

In certain embodiments, pharmaceutical compositions comprise one or more tissue-specific delivery molecules designed to deliver the one or more pharmaceutical agents of the present invention to specific tissues or cell types. For example, in certain embodiments, pharmaceutical compositions include liposomes coated with a tissue-specific antibody.

In certain embodiments, pharmaceutical compositions comprise a co-solvent system. Certain of such co-solvent systems comprise, for example, benzyl alcohol, a nonpolar surfactant, a water-miscible organic polymer, and an aqueous phase. In certain embodiments, such co-solvent systems are used for hydrophobic compounds. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. The proportions of such co-solvent systems may be varied considerably without significantly altering their solubility and toxicity characteristics. Furthermore, the identity of co-solvent components may be varied: for example, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In certain embodiments, pharmaceutical compositions are prepared for oral administration. In certain embodiments, pharmaceutical compositions are prepared for buccal administration. In certain embodiments, a pharmaceutical composition is prepared for administration by injection (e.g., intravenous, subcutaneous, intramuscular, intrathecal (IT), intracerebroventricular (ICV), etc.). In certain of such embodiments, a pharmaceutical composition comprises a carrier and is formulated in aqueous solution, such as water or physiologically compatible buffers such as Hanks's solution, Ringer's solution, or physiological saline buffer. In certain embodiments, other ingredients are included (e.g., ingredients that aid in solubility or serve as preservatives). In certain embodiments, injectable suspensions are prepared using appropriate liquid carriers, suspending agents and the like. Certain pharmaceutical compositions for injection are presented in unit dosage form, e.g., in ampoules or in multi-dose containers. Certain pharmaceutical compositions for injection are suspensions, solutions or emulsions in oily or aqueous vehicles, and may contain formulatory agents such as suspending, stabilizing and/or dispersing agents. Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes.

VI. Certain Compositions

1. Compound No, 1353686

In certain embodiments, Compound No. 1353686 is characterized as a 5-10-5 MOE gapmer having a sequence of (from 5' to 3') GCATTCTCTTATATTCCTTA (SEQ ID NO: 273), wherein each of nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1353686 is represented by the following chemical notation (5' to 3'):

$G_{es}{}^mC_{eo}A_{eo}T_{eo}T_{es}{}^mC_{ds}T_{ds}{}^mC_{ds}T_{ds}T_{ds}A_{ds}T_{ds}A_{ds}T_{ds}T_{ds}{}^m\text{-}C_{eo}{}^mC_{eo}T_{es}T_{es}A_e$ (SEQ ID NO: 273), wherein,
 A=an adenine nucleobase,
 $^m$C=a 5-methyl cytosine nucleobase,
 G=a guanine nucleobase,
 T=a thymine nucleobase,
 e=a 2' MOE sugar moiety,
 d=a 2'-β-D deoxyribosyl sugar moiety,
 s=a phosphorothioate internucleoside linkage, and
 o=a phosphodiester internucleoside linkage.

In certain embodiments, Compound No. 1353686 is represented by the following chemical structure:

Structure 1. Compound No. 1353686

(SEQ ID NO: 273)

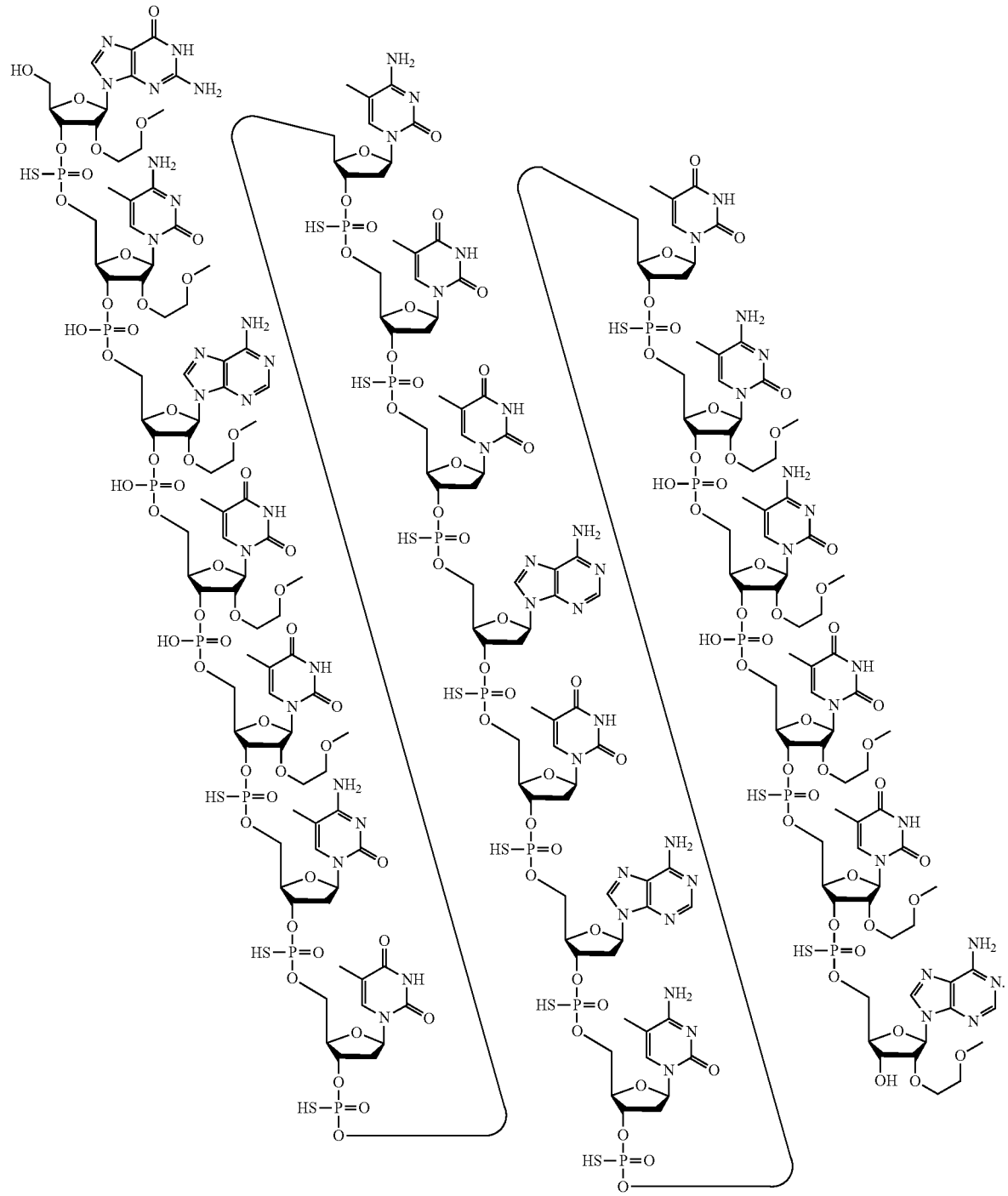

In certain embodiments, the sodium salt of Compound No. 1353686 is represented by the following chemical structure:

Structure 2. The sodium salt of Compound No. 1353686

(SEQ ID NO: 273)

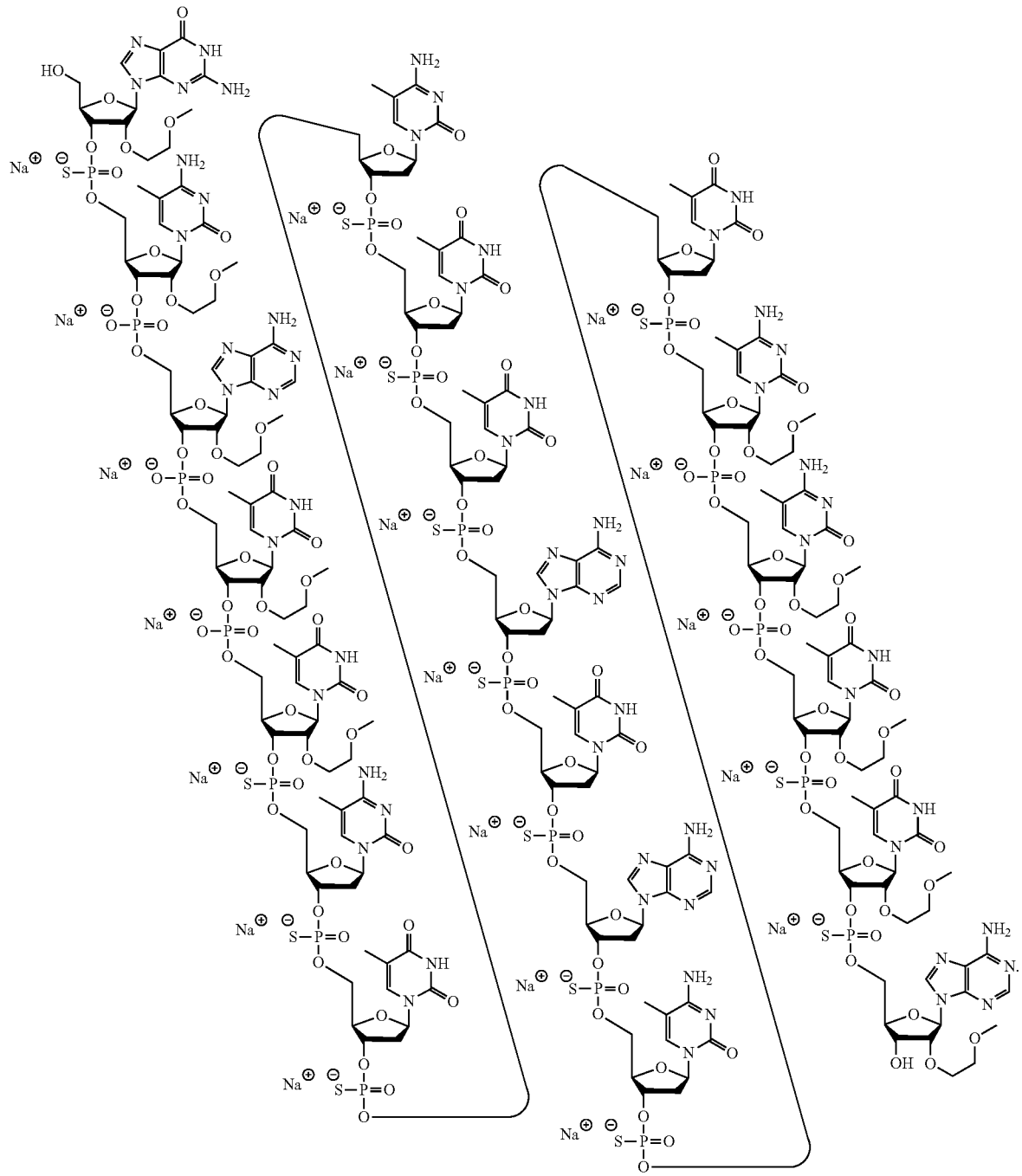

2. Compound No, 1353884

In certain embodiments, Compound No. 1353884 is characterized as a 5-10-5 MOE gapmer having a sequence of (from 5' to 3') GTTTACCTTTAACATTCCTC (SEQ ID NO: 452), wherein each of nucleosides 1-5 and 16-20 (from 5' to 3') are 2'-MOE nucleosides and each of nucleosides 6-15 are 2'-β-D-deoxynucleosides. wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1353884 is represented by the following chemical notation (5' to 3'): G$_{es}$T$_{eo}$T$_{eo}$T$_{eo}$A$_{es}$$^m$C$_{ds}$$^m$C$_{ds}$T$_{ds}$T$_{ds}$T$_{ds}$A$_{ds}$A$_{ds}$$^m$C$_{ds}$A$_{ds}$T$_{ds}$T$_{eo}$$^m$C$_{eo}$$^m$C$_{es}$T$_{es}$$^m$C$_e$ (SEQ ID NO: 452), wherein, A=an adenine nucleobase,
$^m$C=a 5-methyl cytosine nucleobase,
G=a guanine nucleobase,
T=a thymine nucleobase,
e=a 2' MOE sugar moiety,
d=a 2'-β-D deoxyribosyl sugar moiety,
s=a phosphorothioate internucleoside linkage, and
o=a phosphodiester internucleoside linkage.

In certain embodiments, Compound No. 1353884 is represented by the following chemical structure:

Structure 3. Compound No. 1353884

(SEQ ID NO: 452)

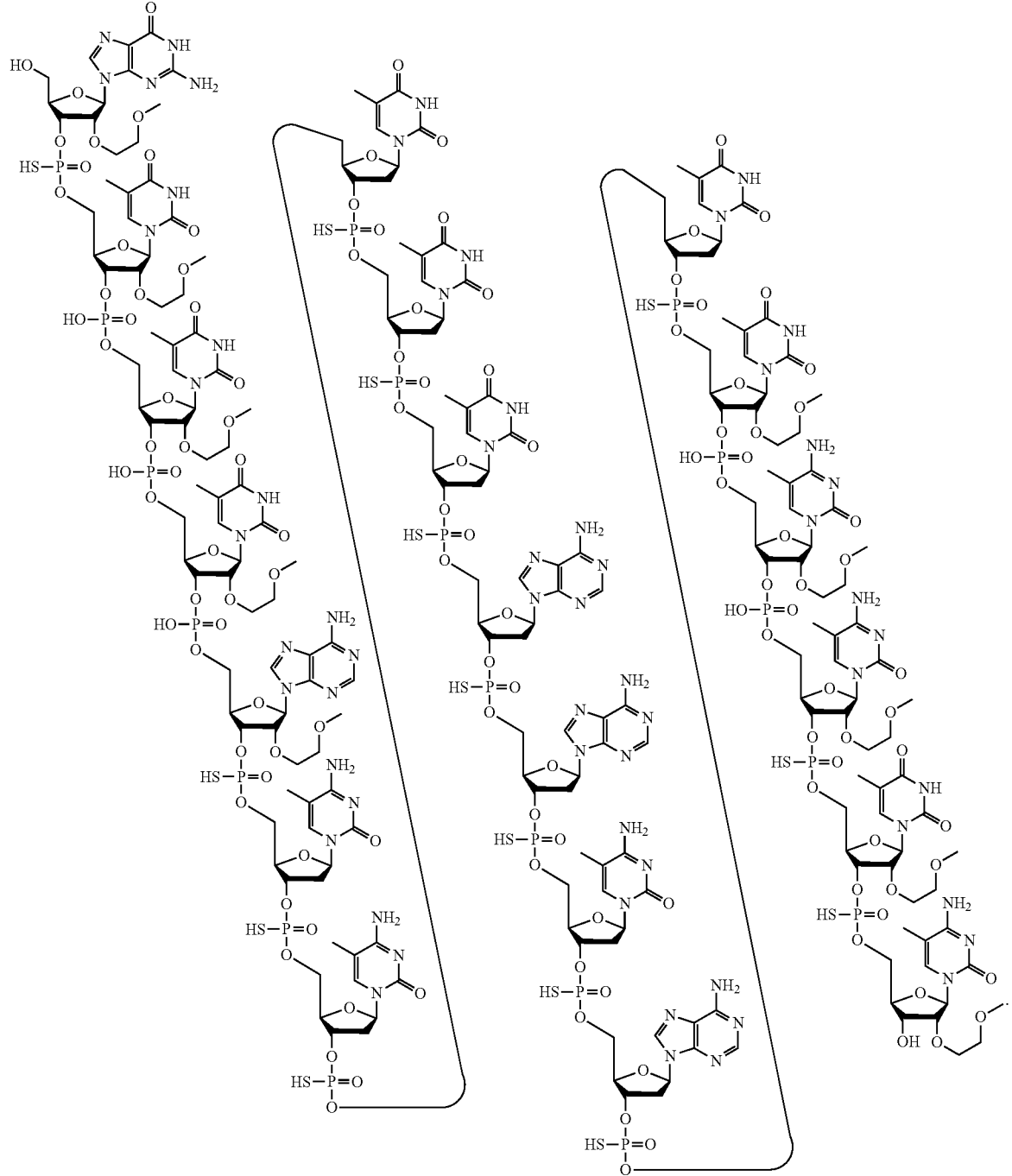

In certain embodiments, the sodium salt of Compound No. 1353884 is represented by the following chemical structure:

Structure 4. The sodium salt of Compound No. 1353884

(SEQ ID NO: 452)

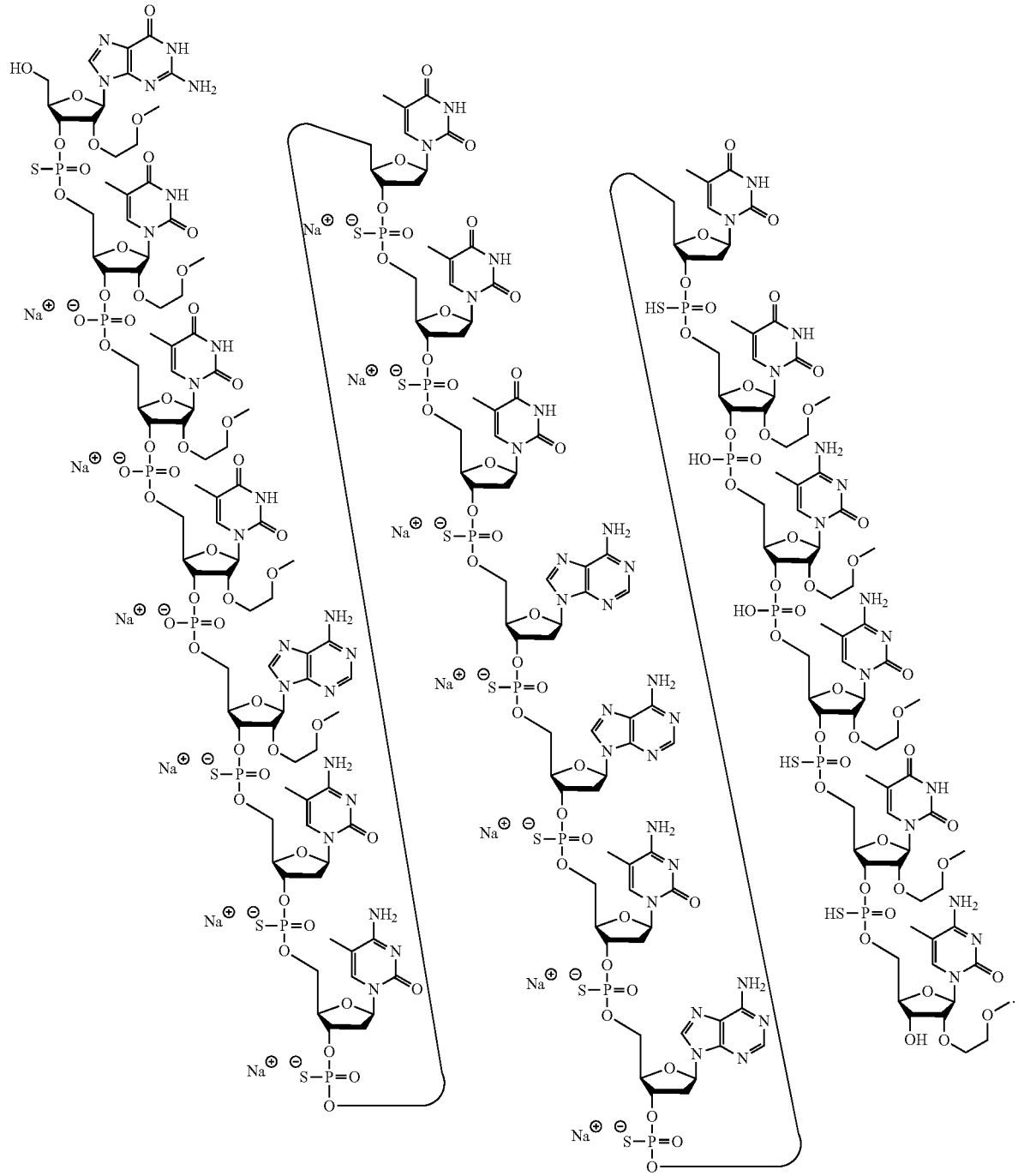

3. Compound No, 1353931

In certain embodiments, Compound No. 1353931 is characterized as a 5-10-5 MOE gapmer having a sequence of (from 5' to 3') GCCATATTGTCATTTTACAC (SEQ ID NO: 462), wherein each of nucleosides 1-5 and 16-20 (from 5' to 3') are 2'-MOE nucleosides and each of nucleosides 6-15 are 2'-(t-D-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1353931 is represented by the following chemical notation (5' to 3'): $G_{es}{}^mC_{eo}{}^mC_{eo}A_{ds}T_{ds}A_{ds}T_{ds}T_{ds}G_{ds}T_{ds}{}^mC_{ds}A_{ds}T_{ds}T_{ds}T_{ds}T_{eo}A_{eo}{}^mC_{es}A_{es}{}^mC_e$ (SEQ ID NO: 462), wherein, A=an adenine nucleobase,
$^mC$=a 5-methyl cytosine nucleobase,
G=a guanine nucleobase,
T=a thymine nucleobase,
e=a 2' MOE sugar moiety,
d=a 2'-β-D deoxyribosyl sugar moiety,
s=a phosphorothioate internucleoside linkage, and
o=a phosphodiester internucleoside linkage.

In certain embodiments, Compound No. 1353931 is represented by the following chemical structure:

Structure 5. Compound No. 1353931

(SEQ ID NO: 462)

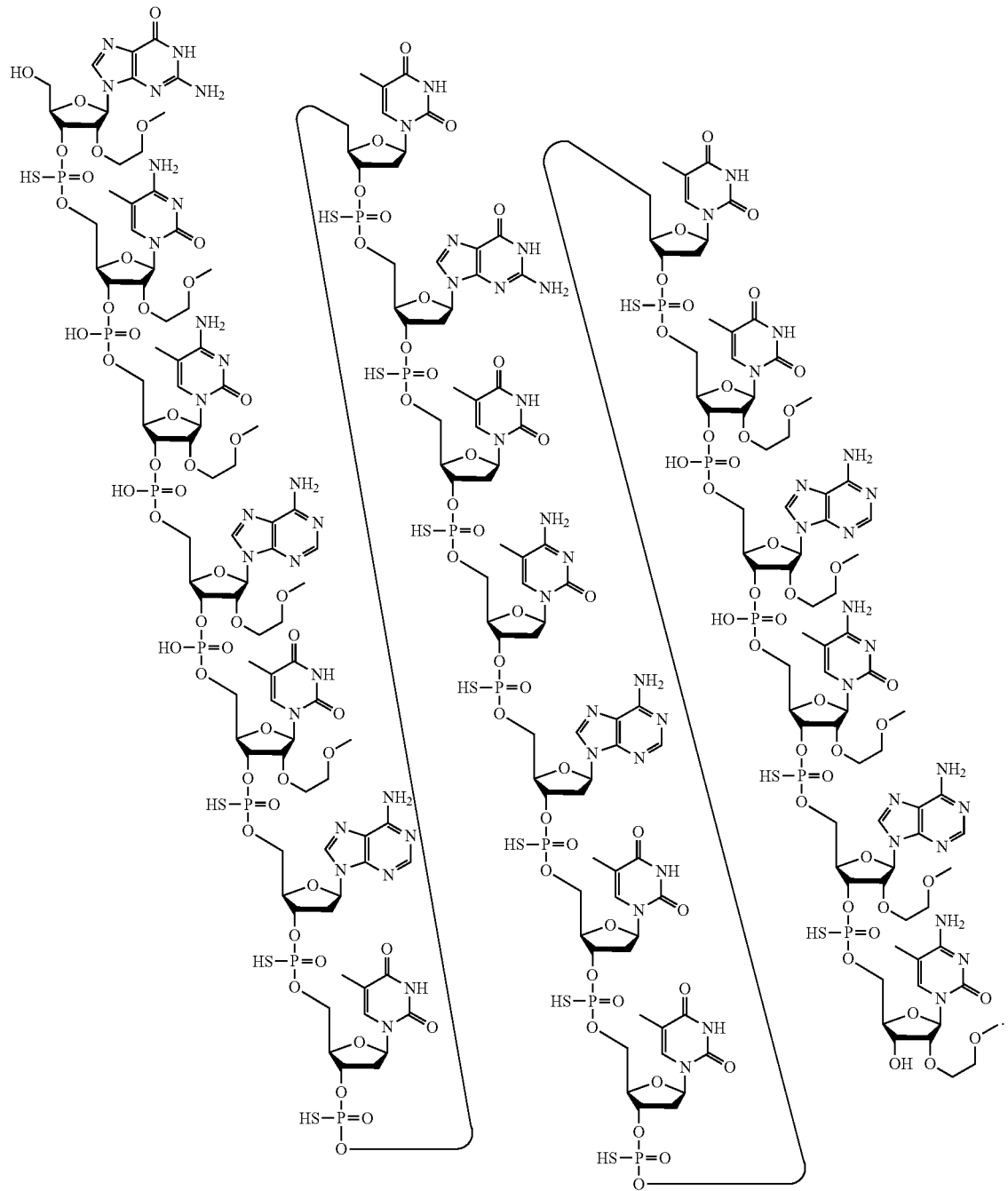

In certain embodiments, the sodium salt of Compound No. 1353931 is represented by the following chemical structure:

Structure 6. The sodium salt of Compound No. 1353931

(SEQ ID NO: 462)

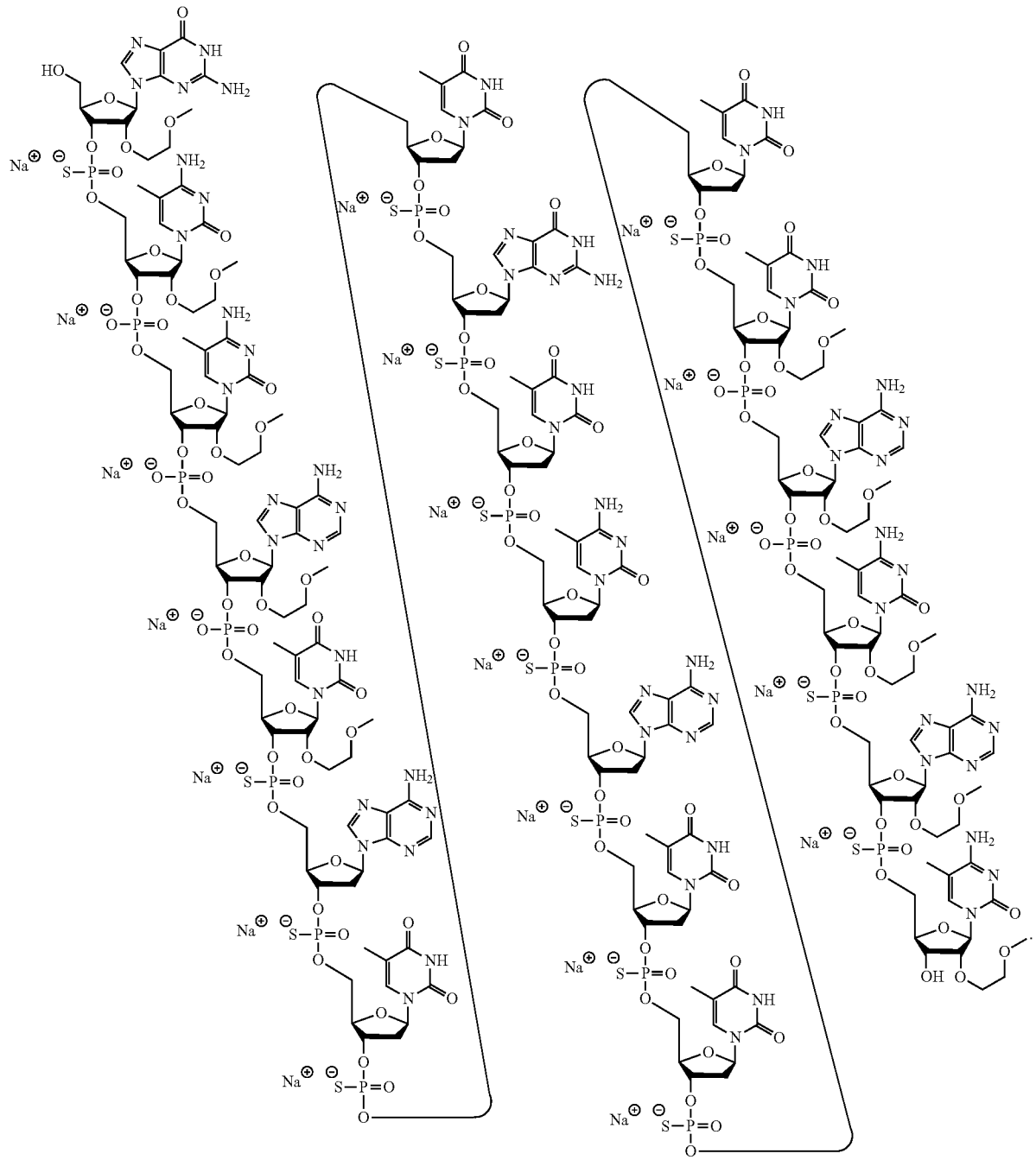

4. Compound No, 1354035

In certain embodiments, Compound No. 1354035 is characterized as a 5-10-5 MOE gapmer having a sequence of (from 5' to 3') GTATCCTCTTAATTCCTATA (SEQ ID NO: 482), wherein each of nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1354035 is represented by the following chemical notation (5' to 3'): $G_{es}T_{eo}A_{eo}T_{eo}{}^mC_{es}{}^mC_{ds}T_{ds}{}^mC_{ds}T_{ds}T_{ds}A_{ds}A_{ds}T_{ds}T_{ds}{}^mC_{ds}{}^mC_{eo}T_{eo}A_{es}T_{es}A_e$ (SEQ ID NO: 482), wherein, A=an adenine nucleobase,
$^mC$=a 5-methyl cytosine nucleobase,
G=a guanine nucleobase,
T=a thymine nucleobase,
e=a 2' MOE sugar moiety,
d=a 2'-β-D deoxyribosyl sugar moiety,
s=a phosphorothioate internucleoside linkage, and
o=a phosphodiester internucleoside linkage.

In certain embodiments, Compound No. 1354035 is represented by the following chemical structure:

Structure 7. Compound No. 1354035

(SEQ ID NO: 482)

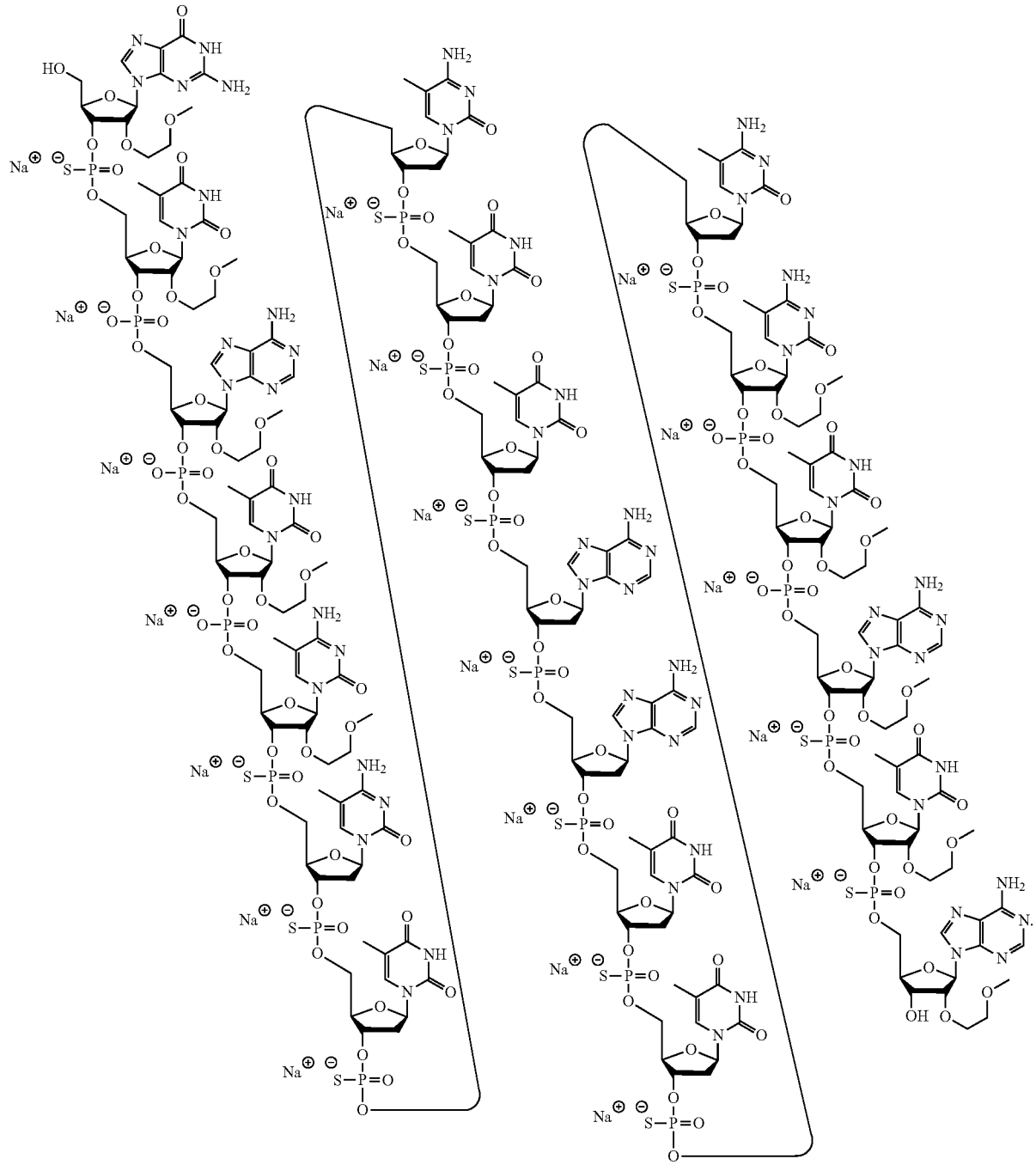

In certain embodiments, the sodium salt of Compound No. 1354035 is represented by the following chemical structure:

Structure 8. The sodium salt of Compound No. 1354035

(SEQ ID NO: 482)

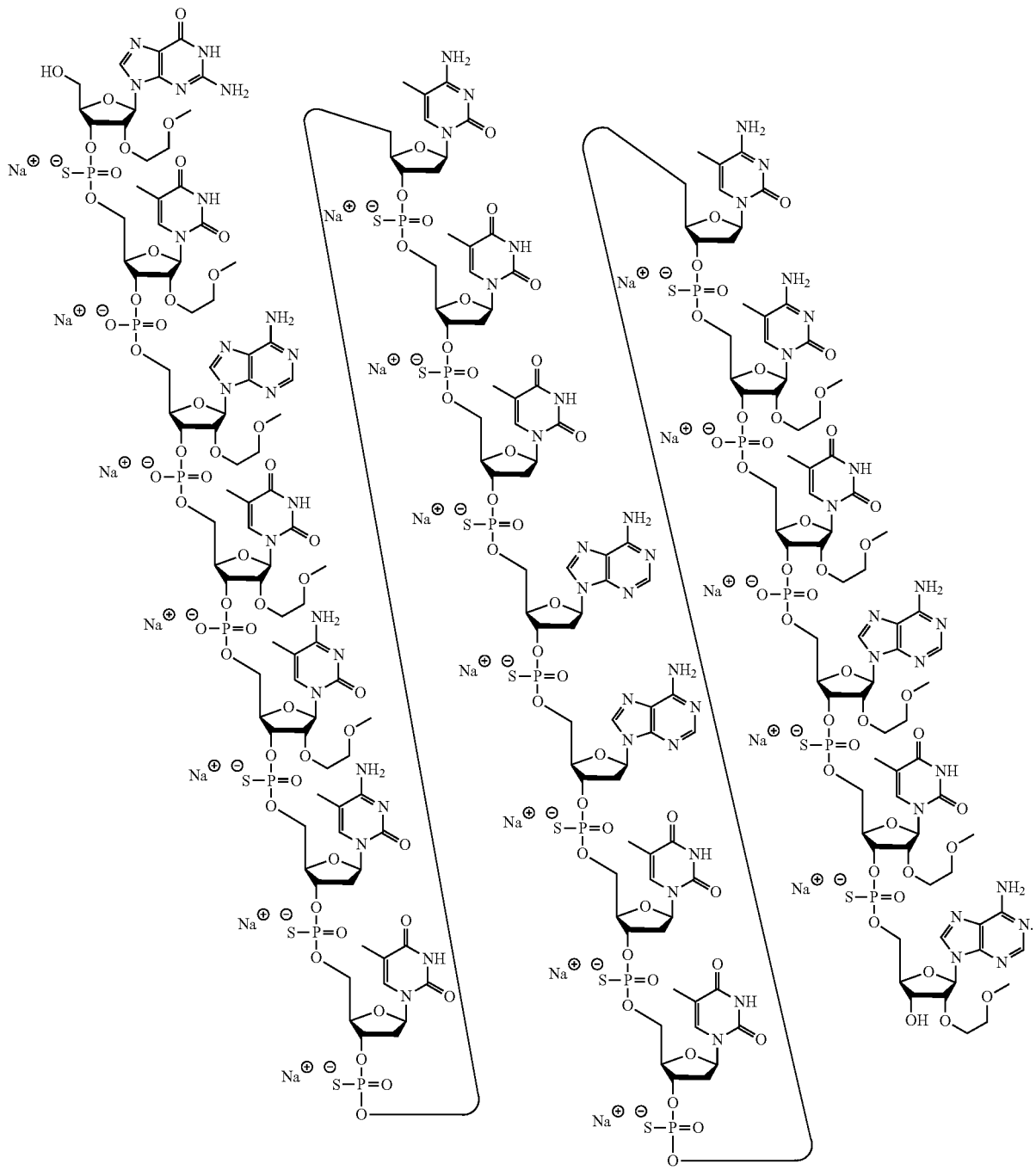

5. Compound No, 1398227

In certain embodiments, Compound No. 1398227 is characterized as a 5-10-5 MOE gapmer having a sequence of (from 5' to 3') CTCCAATTTTAACTTGCACC (SEQ ID NO: 1064), wherein each of nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1398227 is represented by the following chemical notation (5' to 3'):

$^m$C$_{es}$T$_{eo}$$^m$C$_{eo}$$^m$C$_{eo}$A$_{es}$A$_{ds}$T$_{ds}$T$_{ds}$T$_{ds}$T$_{ds}$A$_{ds}$A$_{ds}$$^m$C$_{ds}$T$_{ds}$G$_{eo}$$^m$C$_{eo}$A$_{es}$$^m$C$_{es}$$^m$C$_e$ (SEQ ID NO: 1064), wherein,
A=an adenine nucleobase,
$^m$C=a 5-methyl cytosine nucleobase,
G=a guanine nucleobase,
T=a thymine nucleobase,
e=a 2' MOE sugar moiety,
d=a 2'-β-D deoxyribosyl sugar moiety,
s=a phosphorothioate internucleoside linkage, and
o=a phosphodiester internucleoside linkage.

In certain embodiments, Compound No. 1398227 is represented by the following chemical structure:

Structure 9. Compound No. 1398227

(SEQ ID NO: 1064)

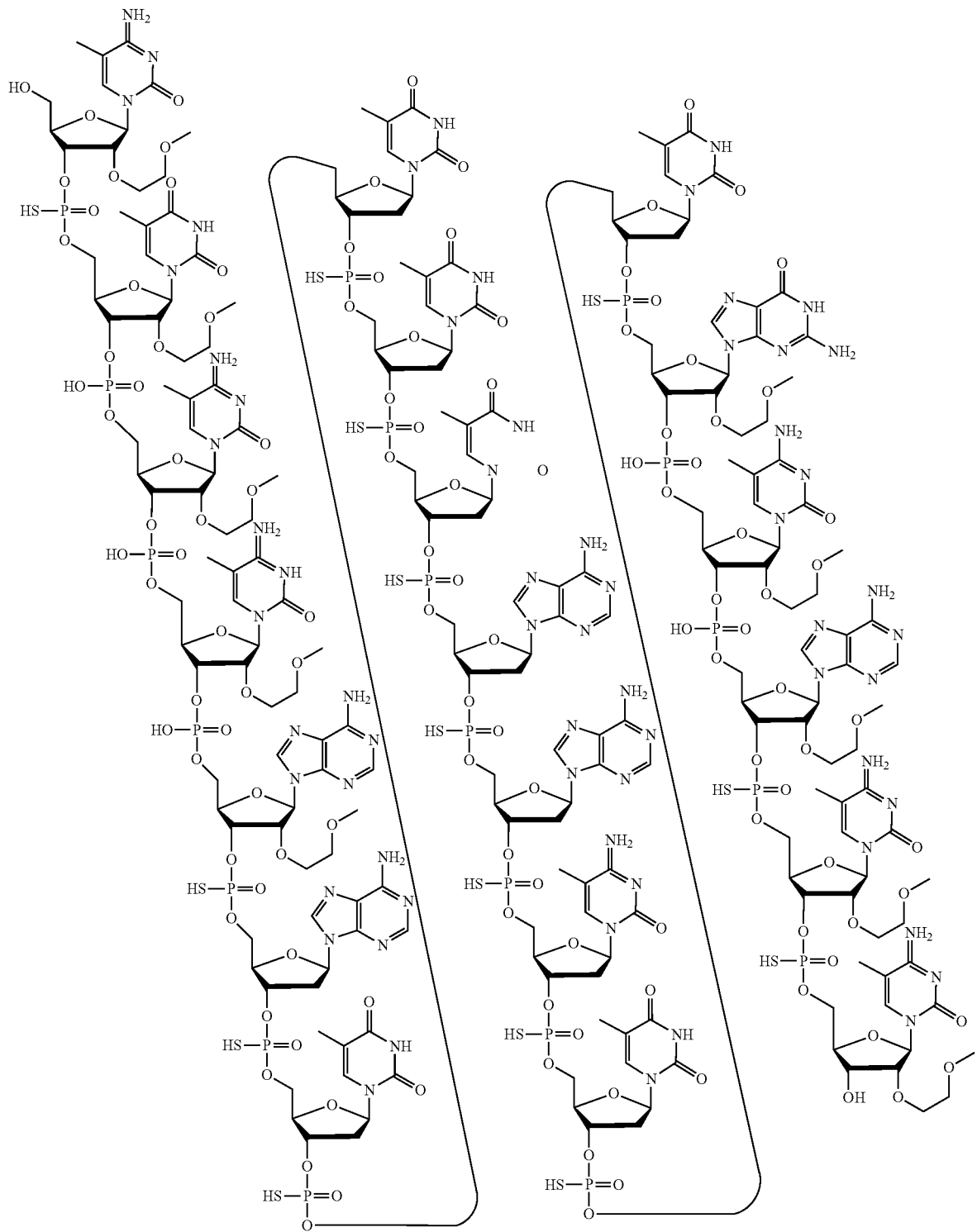

In certain embodiments, the sodium salt of Compound No. 1398227 is represented by the following chemical structure:

Structure 10. The sodium salt of Compound No. 1398227

(SEQ ID NO: 1064)

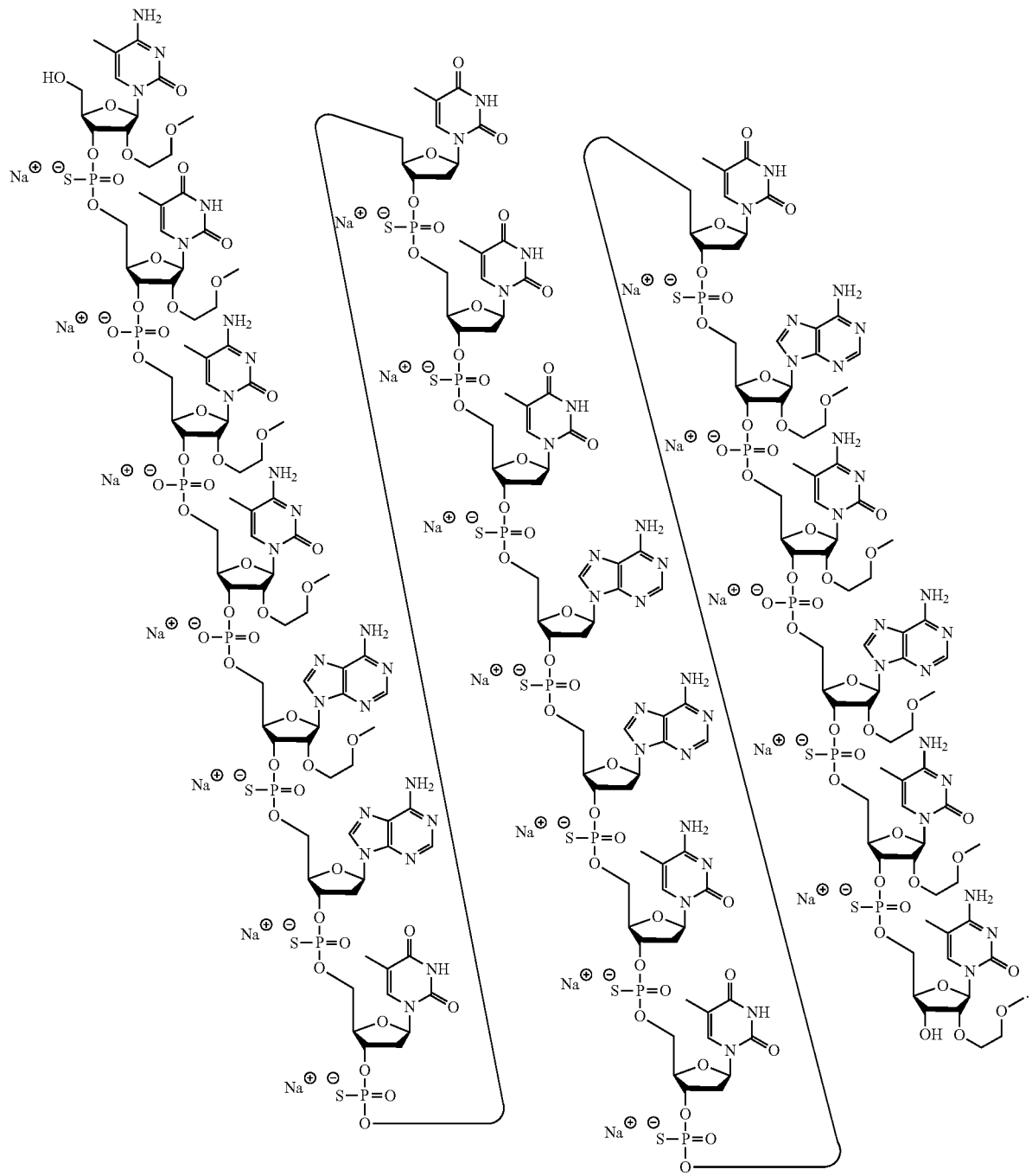

6. Compound No, 1398456

In certain embodiments, Compound No. 1398456 is characterized as a 5-10-5 MOE gapmer having a sequence of (from 5' to 3') GTTCACAGTTTACCCCAAGC (SEQ ID NO: 2225), wherein each of nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1398456 is represented by the following chemical notation (5' to 3'): $G_{es}T_{eo}T_{eo}{}^mC_{eo}A_{es}{}^mC_{ds}A_{ds}G_{ds}T_{ds}T_{ds}T_{d}$-$sA_{ds}{}^mC_{ds}{}^mC_{ds}{}^mC_{ds}{}^mC_{eo}A_{eo}A_{es}G_{es}{}^mC_e$ (SEQ ID NO: 2225), wherein, A=an adenine nucleobase,
$^mC$=a 5-methyl cytosine nucleobase,
G=a guanine nucleobase,
T=a thymine nucleobase,
e=a 2' MOE sugar moiety,
d=a 2'-β-D deoxyribosyl sugar moiety,
s=a phosphorothioate internucleoside linkage, and
o=a phosphodiester internucleoside linkage.

In certain embodiments, Compound No. 1398456 is represented by the following chemical structure:

Structure 11. Compound No. 1398456

(SEQ ID NO. 2225)

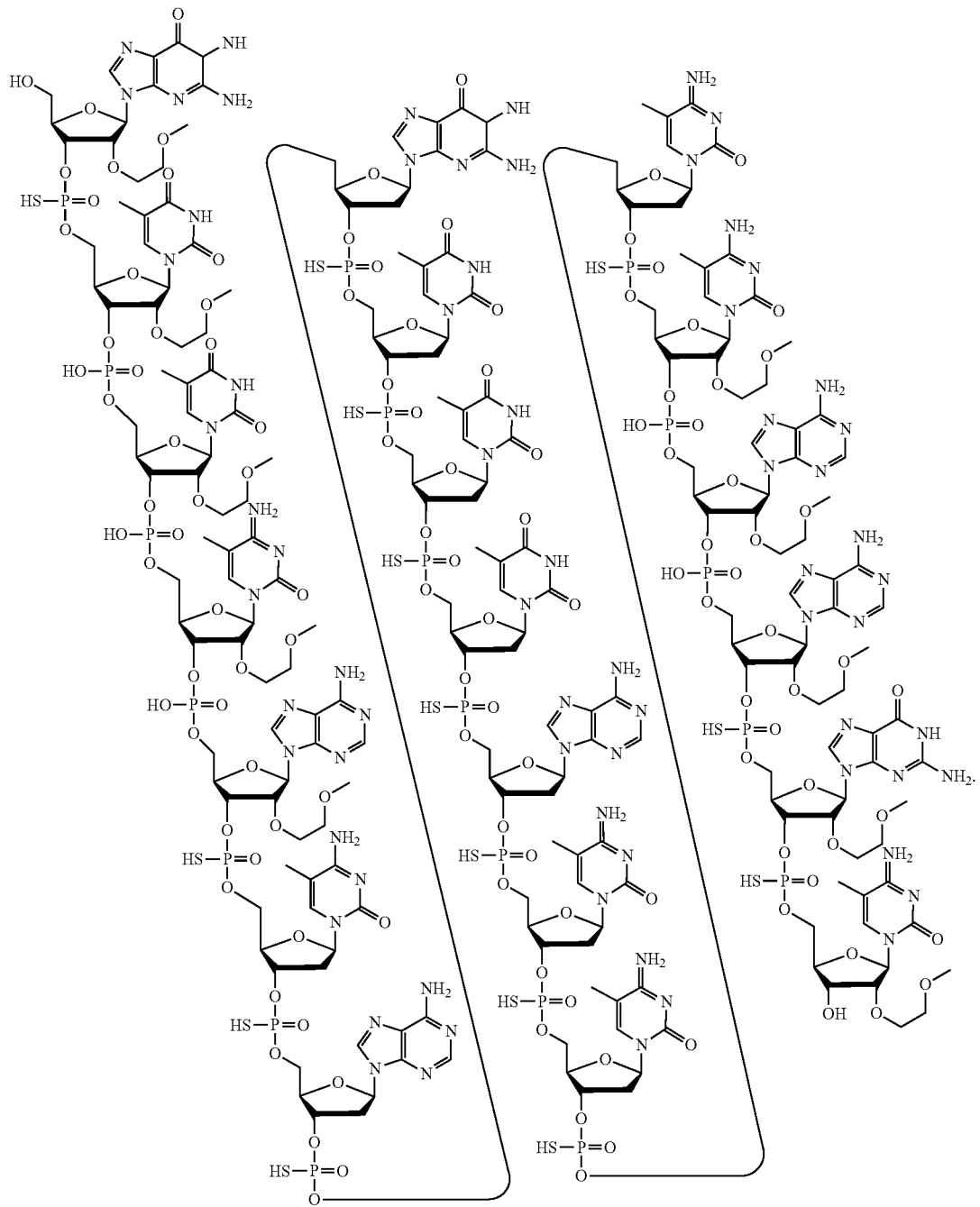

In certain embodiments, the sodium salt of Compound No. 1398456 is represented by the following chemical structure:

Structure 12. The sodium salt of Compound No. 1398456

(SEQ ID NO: 2225)

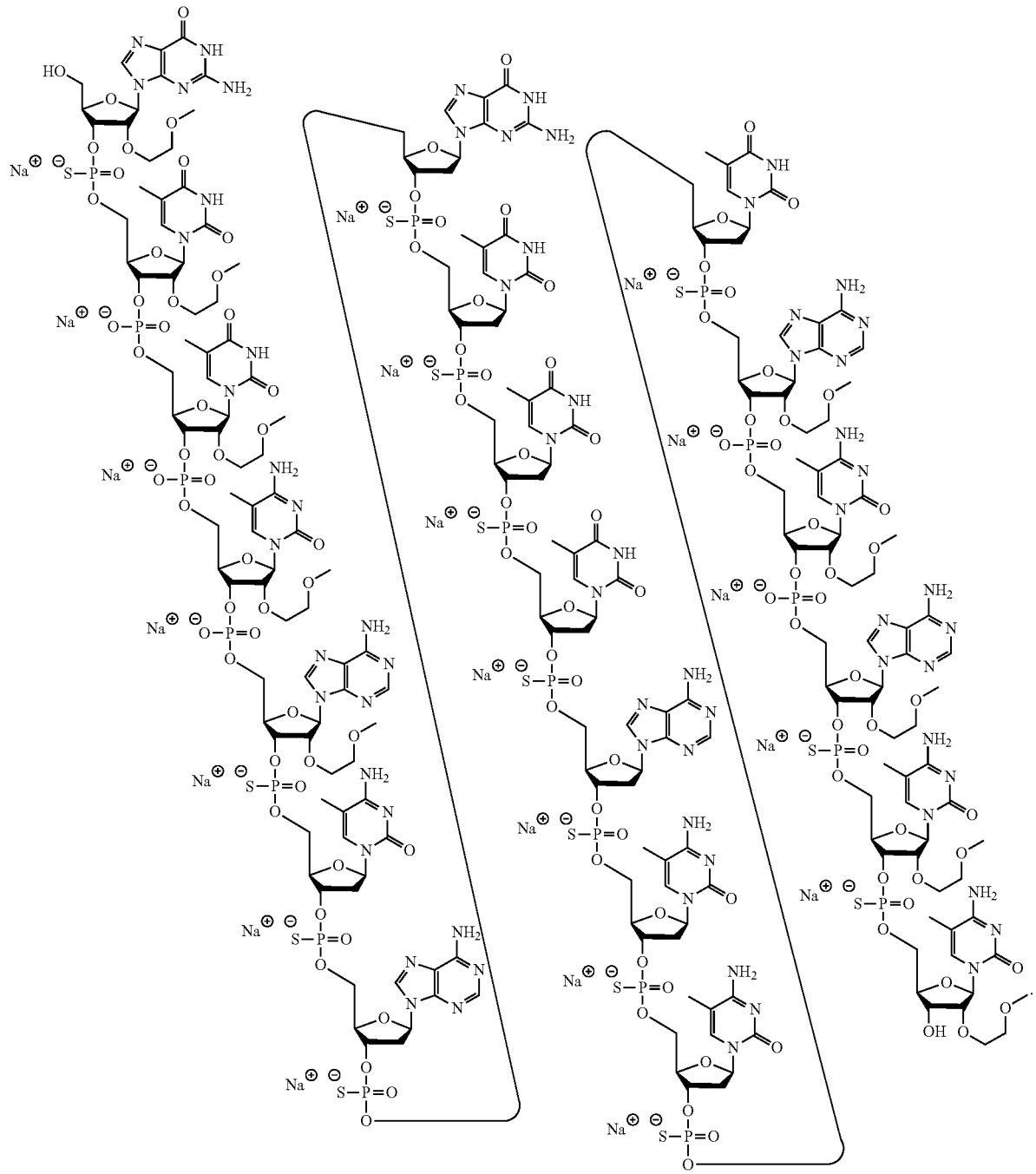

Under certain conditions, certain compounds disclosed herein act as acids. Although such compounds may be drawn or described in protonated (free acid) form, or ionized and in association with a cation (salt) form, aqueous solutions of such compounds exist in equilibrium among such forms. For example, a phosphate linkage of an oligonucleotide in aqueous solution exists in equilibrium among free acid, anion and salt forms. Unless otherwise indicated, compounds described herein are intended to include all such forms. Moreover, certain oligonucleotides have several such linkages, each of which is in equilibrium. Thus, oligonucleotides in solution exist in an ensemble of forms at multiple positions all at equilibrium. The term "oligonucleotide" is intended to include all such forms. Drawn structures necessarily depict a single form. Nevertheless, unless otherwise indicated, such drawings are likewise intended to include corresponding forms. Herein, a structure depicting the free acid of a compound followed by the term "or a salt thereof" expressly includes all such forms that may be fully or partially protonated/de-protonated/in association with a cation. In certain instances, one or more specific cation is identified.

In certain embodiments, modified oligonucleotides or oligomeric compounds are in aqueous solution with sodium. In certain embodiments, modified oligonucleotides or oligomeric compounds are in aqueous solution with potassium. In certain embodiments, modified oligonucleotides or oligomeric compounds are in PBS. In certain embodiments, modified oligonucleotides or oligomeric compounds are in water. In certain such embodiments, the pH of the solution is adjusted with NaOH and/or HCl to achieve a desired pH.

Herein, certain specific doses are described. A dose may be in the form of a dosage unit. For clarity, a dose (or dosage unit) of a modified oligonucleotide or an oligomeric compound in milligrams indicates the mass of the free acid form of the modified oligonucleotide or oligomeric compound. As described above, in aqueous solution, the free acid is in equilibrium with anionic and salt forms. However, for the purpose of calculating dose, it is assumed that the modified oligonucleotide or oligomeric compound exists as a solvent-free, sodium-acetate free, anhydrous, free acid. For example, where a modified oligonucleotide or an oligomeric compound is in solution comprising sodium (e.g., saline), the modified oligonucleotide or oligomeric compound may be partially or fully de-protonated and in association with Na+ ions. However, the mass of the protons are nevertheless counted toward the weight of the dose, and the mass of the Na+ ions are not counted toward the weight of the dose. Thus, for example, a dose, or dosage unit, of 10 mg of a number of fully protonated molecules that weighs 10 mg. This would be equivalent to 10.59 mg of solvent-free, sodium acetate-free, anhydrous sodiated Compound No. 1353686, 1353884, 1353931, 1354035, 1398227, or 1398456. When an oligomeric compound comprises a conjugate group, the mass of the conjugate group is included in calculating the dose of such oligomeric compound. If the conjugate group also has an acid, the conjugate group is likewise assumed to be fully protonated for the purpose of calculating dose.

VII. Certain Comparator Compositions

In certain embodiments, Compound No. 1369631, disclosed as APP2585 in WO/2005/042777 (incorporated herein by reference) is a comparator compound. Compound No. 1369631 is a 5-8-5 ENA-modified oligonucleotide, having a nucleobase sequence (from 5' to 3') TCATGTGCATGTTCAGTC (incorporated herein as SEQ ID NO: 3070). Compound No. 1369631 has a sugar motif (from 5' to 3') aaaaaddddddddaaaaa; wherein each "a" represents an ENA sugar moiety, and each "d" represents a 2'-β-D-deoxyribosyl sugar moiety. Compound No. 1369631 has an internucleoside linkage motif (from 5' to 3'): ssssssssssssssss; wherein each "s" represents a phosphorothioate internucleoside linkage. Each cytosine residue in Compound No. 1369631 is a 5-methyl cytosine.

In certain embodiments, Compound No. 1369632, disclosed as "APP2-666" in WO/2005/042777 is a comparator compound. Compound No. 1369632 is a 6-6-6 ENA-modified oligonucleotide, having a nucleobase sequence (from 5' to 3') TCATGTGCATGTTCAGTC (SEQ ID NO: 3070). Compound No. 1369632 has a sugar motif (from 5' to 3') aaaaaadddddddaaaaaa; wherein each "a" represents an ENA sugar moiety, and each "d" represents a 2'-β-D-deoxyribosyl sugar moiety. Compound No. 1369632 has an internucleoside linkage motif (from 5' to 3'): ssssssssssssssss; wherein each "s" represents a phosphorothioate internucleoside linkage. Each cytosine residue in Compound No. 1369632 is a 5-methyl cytosine.

In certain embodiments, Compound No. 156352, described in US 2003/0232435 (incorporated herein by reference) is a comparator compound. Compound No. 156352 is a 5-10-5 MOE gapmer, having the nucleobase sequence (from 5' to 3') TGTCACTTTCTTCAGCCAGT (incorporated herein as SEQ ID NO: 3071). Compound No. 156352 has a sugar motif (from 5' to 3') eeeeedddddddddddeeeee; wherein each "d" represents a 2'-β-D-deoxyribosyl sugar moiety, and each "e" represents a 2'-MOE sugar moiety. Compound No. 156352 has an internucleoside linkage motif (from 5' to 3'): sssssssssssssssssss; wherein each "s" represents a phosphorothioate internucleoside linkage. Each cytosine residue in Compound No. 156352 is a 5-methyl cytosine.

In certain embodiments, compounds described herein are superior relative to compounds described in WO/2005/042777 and US 2003/0232435 because they demonstrate one or more improved properties.

For example, as provided in Examples 7, 17, and 28, Compound Nos. 1353686, 1353884, 1353931, and 1354035 demonstrate 3 hour functional observational battery (FOB) scores in mice of 0, 0, 1.33, and 0, respectively, while Comparator Compounds 1369631, 1369632, and 156352 demonstrated FOB scores of 6, 2.5, and 6, respectively. Compound Nos. 1353686, 1353884, 1353931, and 1354035 are demonstrably more tolerable than each of Comparator Compound Nos. 1369631, 1369632, and 156352 in this assay.

For example, as provided in Example 27, Compound No. 1398227 demonstrated an 81% reduction and Compound No. 1398456 demonstrated an 84% reduction of APP RNA, while Comparator Compound No. 1369632 demonstrated a 15% reduction of APP RNA in vitro in the standard cell assay in SH-SY5Y cells. Compound Nos. 1398227 and 1398456 are demonstrably more active than Comparator Compound No. 1369632 in this assay.

VIII. Certain Hotspot Regions a. Nucleobases 12566-12609 of SEP ID NO: 2

In certain embodiments, nucleobases 12566-12609 of SEQ ID NO: 2 comprise a hotspot region (hotspot ID No. 5). In certain embodiments, modified oligonucleotides are complementary within nucleobases 12566-12609 of SEQ ID NO: 2. In certain embodiments, modified oligonucleotides are 20 nucleobases in length. In certain embodiments, modified oligonucleotides are gapmers. In certain embodiments, modified oligonucleotides are 5-10-5 or 6-10-4 gapmers. In certain embodiments, the gapmers are MOE gapmers. In certain embodiments, modified oligonucleotides have the sugar motif eeeeedddddddddddeeeee, wherein each "e" is nucleoside comprising a 2'-MOE sugar moiety and each "d" is a nucleoside comprising a 2'-β-D-deoxyribosyl sugar moiety. In certain embodiments, modified oligonucleotides have the sugar motif eeeeeeddddddddddeeee, wherein each "e" is nucleoside comprising a 2'-MOE sugar moiety, and each "d" is a nucleoside comprising a 2'-β-D-deoxyribosyl sugar moiety. In certain embodiments, the nucleosides of the modified oligonucleotides are linked by phosphorothioate internucleoside linkages and phosphodiester internucleoside linkages. In certain embodiments, the phosphodiester ("o")

and phosphorothioate ("s") internucleoside linkages are arranged in order from 5' to 3': sooossssssssssooss or sooooosssssssssssoss.

The nucleobase sequences of SEQ ID Nos: 273, 744, 824, 898 and 1025 are complementary within nucleobases 12566-12609 of SEQ ID NO: 2.

Compounds 1353686, 1397821, 1397908, 1398005, 1399362, and 1539870 are complementary within nucleobases 12566-12609 of SEQ ID NO: 2.

In certain embodiments, modified oligonucleotides complementary within nucleobases 12566-12609 of SEQ ID NO: 2. achieve at least 49% reduction of APP RNA in vitro in the standard cell assay in SH-SY5Y cells. In certain embodiments, modified oligonucleotides complementary within nucleobases 12566-12609 of SEQ ID NO: 2 achieve an average of 69% reduction of APP RNA in vitro in the standard cell assay in SH-SY5Y cells.

b. Nucleobases 158596-158982 of SEP ID NO: 2

In certain embodiments, nucleobases 158596-158982 of SEQ ID NO: 2 comprise a hotspot region (hotspot ID no. 9). In certain embodiments, modified oligonucleotides are complementary within nucleobases 158596-158982 of SEQ ID NO: 2. In certain embodiments, modified oligonucleotides are 20 nucleobases in length. In certain embodiments, modified oligonucleotides are gapmers. In certain embodiments, modified oligonucleotides are 5-10-5 or 6-10-4 gapmers. In certain embodiments, the gapmers are MOE gapmers. In certain embodiments, modified oligonucleotides have the sugar motif eeeeedddddddddddeeeee, wherein each "e" is nucleoside comprising a 2'-MOE sugar moiety and each "d" is a nucleoside comprising a 2'-β-D-deoxyribosyl sugar moiety. In certain embodiments, modified oligonucleotides have the sugar motif eeeeeedddddddddeeeee, wherein each "e" is nucleoside comprising a 2'-MOE sugar moiety, and each "d" is a nucleoside comprising a 2'-β-D-deoxyribosyl sugar moiety. In certain embodiments, the nucleosides of the modified oligonucleotides are linked by phosphorothioate internucleoside linkages and phosphodiester internucleoside linkages. In certain embodiments, the phosphodiester ("o") and phosphorothioate ("s") internucleoside linkages are arranged in order from 5' to 3': sooossssssssssssooss or sooooosssssssssssoss.

The nucleobase sequences of SEQ ID Nos: 178, 547, 577, 693, 769, 846, 2225, 2480, and 3047-30505 are complementary within nucleobases 158596-158982 of SEQ ID NO: 2.

Compounds 1354057, 1397573, 1398456, 1398549, 1398604, 1398618, 1398913, 1399136, 1539237-1539240, and 1539867 are complementary within nucleobases 158596-158982 of SEQ ID NO: 2.

In certain embodiments, modified oligonucleotides complementary within nucleobases 158596-158982 of SEQ ID NO: 2. achieve at least 60% reduction of APP RNA in vitro in the standard cell assay in SH-SY5Y cells. In certain embodiments, modified oligonucleotides complementary within nucleobases 12566-12609 of SEQ ID NO: 2 achieve an average of 73% reduction of APP RNA in vitro in the standard cell assay in SH-SY5Y cells.

c. Nucleobases 292896-292922 of SEP ID NO: 2

In certain embodiments, nucleobases 292896-292922 of SEQ ID NO: 2 comprise a hotspot region (hotspot ID No. 32). In certain embodiments, modified oligonucleotides are complementary within nucleobases 292896-292922 of SEQ ID NO: 2. In certain embodiments, modified oligonucleotides are 20 nucleobases in length. In certain embodiments, modified oligonucleotides are gapmers. In certain embodiments, modified oligonucleotides are 5-10-5 gapmers. In certain embodiments, the gapmers are MOE gapmers. In certain embodiments, modified oligonucleotides have the sugar motif eeeeedddddddddddeeeee, wherein each "e" is nucleoside comprising a 2'-MOE sugar moiety and each "d" is a nucleoside comprising a 2'-β-D-deoxyribosyl sugar moiety. In certain embodiments, the nucleosides of the modified oligonucleotides are linked by phosphorothioate internucleoside linkages and phosphodiester internucleoside linkages. In certain embodiments, the phosphodiester ("o") and phosphorothioate ("s") internucleoside linkages are arranged in order from 5' to 3': sooosssssssssssooss.

The nucleobase sequences of SEQ ID Nos: 35, 411, and 482 are complementary within nucleobases 292896-292922 of SEQ ID NO: 2.

Compounds 1354044, 1354035, and 1353677 are complementary within nucleobases 292896-292922 of SEQ ID NO: 2.

In certain embodiments, modified oligonucleotides complementary within nucleobases 292896-292922 of SEQ ID NO: 2. achieve at least 65% reduction of APP RNA in vitro in the standard cell assay in SH-SY5Y cells. In certain embodiments, modified oligonucleotides complementary within nucleobases 292896-292922 of SEQ ID NO: 2 achieve an average of 71% reduction of APP RNA in vitro in the standard cell assay in SH-SY5Y cells.

d. Additional Hotspot Regions

In certain embodiments, the ranges described in the Table below comprise hotspot regions, including those described above. Each hotspot region begins with the nucleobase of SEQ ID NO: 2 identified in the "Start Site SEQ ID NO: 2" column and ends with the nucleobase of SEQ ID NO: 2 identified in the "Stop Site SEQ ID NO: 2" column. In certain embodiments, oligomeric compounds comprise modified oligonucleotides that are complementary within any of the hotspot regions 1-32, as defined in the table below. In certain embodiments, modified oligonucleotides are 16 nucleobases in length. In certain embodiments, modified oligonucleotides are 20 nucleobases in length.

In certain embodiments, oligomeric compounds comprise modified oligonucleotides that are gapmers. In certain embodiments, modified oligonucleotides have the sugar motif eeeeedddddddddddeeeee, wherein each "e" is nucleoside comprising a 2'-MOE sugar moiety and each "d" is a nucleoside comprising a 2'-β-D-deoxyribosyl sugar moiety. In certain embodiments, modified oligonucleotides have the sugar motif eeeeeedddddddddeeeee, wherein each "e" is nucleoside comprising a 2'-MOE sugar moiety, and each "d" is a nucleoside comprising a 2'-β-D-deoxyribosyl sugar moiety. In certain embodiments, modified oligonucleotides have the sugar motif kkkdddddddddddkkk, wherein each "k" is a nucleoside comprising a cEt sugar moiety, and each "d" is a nucleoside comprising a 2'-β-D-deoxyribosyl sugar moiety. In certain embodiments, modified oligonucleotides have the sugar motif kkkdydddddddddkkk, wherein each "y" is nucleoside comprising a 2'-OMe sugar moiety, each "k" is a nucleoside comprising a cEt sugar moiety, and each "d" is a nucleoside comprising a 2'-β-D-deoxyribosyl sugar moiety. In certain embodiments, modified oligonucleotides are 5-10-5 or 6-10-4 MOE gapmers. In certain embodiments, modified oligonucleotides are 3-10-3 cEt gapmers. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3').

In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': In certain embodiments, modified nucleotides have an internucleoside linkage motif of sooosssssssssos, soooooossssssssssoss, sooosssssssss-sooss, soooooossssssssssoss, sooossssssssssooos, or ssoossssssssssssooss, wherein each "s" represents a phosphorothioate internucleoside linkage and each "o" represents a phosphodiester internucleoside linkage.

In certain embodiments, modified oligonucleotides complementary to nucleobases within an in vitro hotspot region achieve at least "Min.% Red. in vitro" in SH-SY5Y and/or A431 cells (minimum % reduction, relative to untreated control cells) of APP RNA in vitro in the standard cell assay, as indicated in the table below. In certain embodiments, modified oligonucleotides complementary to nucleobases within the hotspot region achieve an average of "Avg.% Red. in vitro" in SH-SY5Y and/or A431 cells (average % reduction, relative to untreated control cells) of APP RNA in vitro in the standard cell assay, as indicated in the table below. In certain embodiments, modified oligonucleotides complementary to nucleobases within the hotspot region achieve a maximum of "Max. % Red. in vitro" in SH-SY5Y and/or A431 cells (maximum % reduction, relative to untreated control cells) of APP RNA in vitro in the standard cell assay, as indicated in the table below.

TABLE A

APP in vitro Hotspot Regions

| ID | SEQ ID NO: 2 Start Site | SEQ ID NO: 2 Stop Site | SH-SY5Y Cells | | | A431 Cells | | | Compound No. in range | SEQ ID NO in range |
|---|---|---|---|---|---|---|---|---|---|---|
| | | | Min. % Red. in vitro | Max. % Red. in vitro | Avg. % Red. in vitro | Min. % Red. in vitro | Max. % Red. in vitro | Avg. % Red. in vitro | | |
| 1 | 6193 | 6245 | 57 | 83 | 77 | n.d. | n.d. | n.d. | 1353833, 1397770, 1398054, 1398752, 1399103 | 140, 1240, 1279, 1402, 1437 |
| 2 | 9622 | 9656 | 72 | 87 | 80 | n.d. | n.d. | n.d. | 1353668, 1353736, 1398653 | 116, 202, 626 |
| 3 | 10203 | 10249 | 57 | 72 | 64 | n.d. | n.d. | n.d. | 1397525, 1397713, 1398045, 1398267, 1398674, 1398782 | 830, 912, 962, 1049, 1164, 1236 |
| 4 | 11246 | 11287 | 74 | 84 | 78 | n.d. | n.d. | n.d. | 1353733, 1397711, 1399201 | 201, 1741, 1870 |
| 5 | 12566 | 12609 | 49 | 81 | 69 | n.d. | n.d. | n.d. | 1353686, 1397821, 1397908, 1398005, 1399362, 1539870 | 273, 744, 824, 898, 1025 |
| 6 | 22914 | 22964 | 60 | 95 | 75 | n.d. | n.d. | n.d. | 1353832, 1353861, 1397580, 1398429, 1398671, 1398737, 1399267 | 296, 384, 1568, 1617, 1701, 1734, 1841 |
| 7 | 154394 | 154420 | 74 | 84 | 78 | n.d. | n.d. | n.d. | 1398034, 1398895, 1399087, 1399234, 1399503 | 1553, 1593, 1709, 1805, 1873 |
| 8 | 154736 | 154760 | 52 | 81 | 70 | n.d. | n.d. | n.d. | 1354072, 1397866, 1397905, 1398238, 1399015, 1399275 | 340, 519, 590, 711, 795, 819 |
| 9 | 158596 | 158982 | 60 | 91 | 73 | n.d. | n.d. | n.d. | 1354057, 1397573, 1398456, 1398549, 1398604, 1398618, 1398913, 1399136, 1539237-1539240, 1539867 | 178, 547, 577, 693, 769, 846, 2225, 2480, 3047-3050 |
| 10 | 159558 | 159581 | 64 | 89 | 77 | n.d. | n.d. | n.d. | 1353731, 1397655, 1397959, 1398047, 1398505 | 200, 1688, 1740, 1820, 1906 |
| 11 | 220028 | 220077 | n.d. | n.d. | n.d. | 47 | 95 | 78 | 1463194, 1463199, 1463229, 1463297, 1463307, 1463320, 1463404, 1463479, 1463511, 1463521, 1463543 | 2576, 2493, 2660, 2708, 2790, 2806, 2854, 2900, 2903, 2993, 3013 |
| 12 | 220237 | 220281 | n.d. | n.d. | n.d. | 74 | 96 | 89 | 1463386, 1463394, 1463203, 1463553, 1463464, 1463286, 1463389 | 2590, 2690, 2691, 2760, 2808, 2939, 3002 |
| 13 | 220368 | 220426 | n.d. | n.d. | n.d. | 61 | 81 | 79 | 1463445, 1463600, 1463482, 1463516, 1463226, 1463185, 1463204, 1463555 | 2580, 2652, 2728, 2772, 2866, 2874, 2931, 3012 |
| 14 | 220710 | 220766 | n.d. | n.d. | n.d. | 77 | 95 | 87 | 1463195, 1463223, 1463276, 1463472, 1463483, 1463497 | 2619, 2671, 2783, 2812, 2875, 2929 |
| 15 | 220892 | 220919 | n.d. | n.d. | n.d. | 84 | 96 | 92 | 1463172, 1463192, 1463294, 1463361, 1463374, 1463388, 1463498, 1463578 | 2638, 2649, 2676, 2753, 2757, 2804, 2932, 2983 |

TABLE A-continued

APP in vitro Hotspot Regions

| | | | SH-SY5Y Cells | | | A431 Cells | | | |
|---|---|---|---|---|---|---|---|---|---|
| ID | SEQ ID NO: 2 Start Site | SEQ ID NO: 2 Stop Site | Min. % Red. in vitro | Max. % Red. in vitro | Avg. % Red. in vitro | Min. % Red. in vitro | Max. % Red. in vitro | Avg. % Red. in vitro | Compound No. in range | SEQ ID NO in range |
| 16 | 221002 | 221025 | n.d. | n.d. | n.d. | 86 | 92 | 88 | 1463181, 1463225, 1463248, 1463446 | 2575, 2848, 2890, 2965 |
| 17 | 221138 | 221177 | n.d. | n.d. | n.d. | 78 | 89 | 85 | 1463188, 1463190, 1463252, 1463277, 1463349 | 2583, 2654, 2748, 2823, 2882 |
| 18 | 221315 | 221364 | 79 | 83 | 81 | 88 | 95 | 91 | 1398485, 1398644, 1399147, 1399147, 1463176, 1463289, 1463324, 1463380, 1463425, 1463454, 1463455, 1463542 | 1557, 1613, 1696, 2592, 2699, 2713, 2775, 2844, 2879, 2977, 2986 |
| 19 | 222414 | 222478 | 59 | 59 | 59 | 73 | 94 | 86 | 1354064, 1463179, 1463261, 1463268, 1463304, 1463376, 1463379, 1463381, 1463433, 1463510, 1463522, 1463595, 1463612 | 338, 2574, 2642, 2666, 2689, 2740, 2754, 2847, 2859, 2899, 2950, 2987, 3014 |
| 20 | 222548 | 222590 | n.d. | n.d. | n.d. | 72 | 93 | 86 | 1463589, 1463290, 1463599, 1463485, 1463499, 1463305 | 2641, 2675, 2799, 2856, 2933, 2974 |
| 21 | 222663 | 222697 | n.d. | n.d. | n.d. | 63 | 90 | 76 | 1463484, 1463459, 1463584, 1463182, 1463409, 1463527 | 2610, 2780, 2851, 2943, 2956 |
| 22 | 222764 | 222791 | n.d. | n.d. | n.d. | 91 | 87 | 85 | 1463424, 1463481, 1463440, 1463384 | 2766, 2855, 2925, 2988 |
| 23 | 225366 | 225400 | n.d. | n.d. | n.d. | 69 | 91 | 78 | 1463178, 1463264, 1463336, 1463417, 1463422, 1463525, 1463547, 1463552, 1463560, 1463608 | 2645, 2715, 2727, 2787, 2842, 2843, 2938, 2940, 2967, 2978 |
| 24 | 226497 | 226532 | 68 | 68 | 68 | 86 | 92 | 89 | 1353844, 1463546, 1463577 | 299, 2632, 3020 |
| 25 | 229282 | 229306 | n.d. | n.d. | n.d. | 70 | 91 | 83 | 1463288, 1463344, 1463494, 1463512, 1463550, 1463562 | 2591, 2705, 2747, 2865, 2941, 3010 |
| 26 | 231282 | 231310 | n.d. | n.d. | n.d. | 71 | 91 | 82 | 1463228, 1463244, 1463308, 1463353, 1463356, 1463489, 1463533, 1463535, 1463537 | 2621, 2629, 2679, 2687, 2735, 2788, 2864, 2912, 2966 |
| 27 | 234328 | 234370 | n.d. | n.d. | n.d. | 78 | 91 | 86 | 1463292, 1463313, 1463339, 1463460 | 2701, 2742, 2828, 2908 |
| 28 | 234802 | 234827 | n.d. | n.d. | n.d. | 78 | 90 | 85 | 1363337, 1463426, 1463575 | 2611, 2717, 2979 |
| 29 | 34556 | 34575 | 91 | 91 | 91 | n.d. | n.d. | n.d. | 1398227 | 1064 |
| 30 | 101718 | 101737 | 84 | 84 | 84 | n.d. | n.d. | n.d. | 1353931 | 462 |
| 31 | 158795 | 158814 | 82 | 82 | 82 | n.d. | n.d. | n.d. | 1353884 | 452 |
| 32 | 292896 | 292922 | 64 | 75 | 71 | n.d. | n.d. | n.d. | 1354044, 1354035, 1353677 | 35, 411, 482 |

IX. Certain RNAi Compositions

In certain embodiments, oligomeric duplexes comprise a first oligomeric compound comprising a first modified oligonucleotide and a second oligomeric compound comprising a second modified oligonucleotide. In certain embodiments, the first modified oligonucleotide is an antisense RNAi oligonucleotide and the second modified oligonucleotide is a sense RNAi oligonucleotide. In certain embodiments, oligomeric duplexes comprise an antisense RNAi oligonucleotide complementary to a human APP nucleic acid and a sense oligonucleotide complementary to the antisense RNAi oligonucleotides.

In certain embodiments, Compound No. 1581405 is an oligomeric duplex comprising a first oligomeric compound comprising an antisense RNAi oligonucleotide Compound No. 1551732 and a second oligomeric compound comprising a sense RNAi oligonucleotide Compound No. 1579196. In certain embodiments, Compound No. 1581406 is an oligomeric duplex comprising a first oligomeric compound comprising an antisense RNAi oligonucleotide Compound No. 1551735 and second oligomeric compound comprising a sense RNAi oligonucleotide Compound No. 1551736. In certain embodiments, Compound No. 1581407 is an oligomeric duplex comprising a first oligomeric compound comprising an antisense RNAi oligonucleotide Compound No. 1551737 and a second oligomeric compound comprising a sense RNAi oligonucleotide Compound No. 1551741. In certain embodiments, Compound No. 1581408 is an oligomeric duplex comprising a first oligomeric compound comprising an antisense RNAi oligonucleotide Compound No. 1551739 and a second oligomeric compound comprising a sense RNAi oligonucleotide Compound No. 1551740. In certain embodiments, Compound No. 1581409 is an oligomeric duplex comprising a first oligomeric compound comprising an antisense RNAi oligonucleotide Compound No. 1551742 and a second oligomeric compound comprising a sense RNAi oligonucleotide Compound No. 1551743. In certain embodiments, Compound No. 1581410 is an oligomeric duplex comprising a first oligomeric compound comprising an antisense RNAi oligonucleotide Compound No. 1551744 and a second oligomeric compound comprising a sense RNAi oligonucleotide Compound No. 1551745.

Certain oligomeric duplexes comprise a first oligomeric compound comprising a first modified oligonucleotide and a second oligomeric compound comprising a second modified oligonucleotide according to chemical notations as provided in Table B below. As set forth in Table B:
  A=an adenine nucleobase,
  C=a cytosine nucleobase,
  G=a guanine nucleobase,
  T=a thymine nucleobase,
  U=a uracil nucleobase,
  e=a 2' MOE sugar moiety,
  y=a 2'-O-methylribosyl sugar moiety,
  f=a 2'-fluororibosyl sugar moiety,
  s=a phosphorothioate internucleoside linkage,
  o=a phosphodiester internucleoside linkage,
  C16muP=a hexadecane sulfonyl phosphoramidate internucleoside linkage, and
  VP=a 5'-vinylphosphonate.

intended to limit the same. Each of the references, GenBank accession numbers, ENSEMBL identifiers, and the like recited in the present application is incorporated herein by reference in its entirety.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH in place of one 2'-H of DNA) or as an RNA having a modified base (thymine (methylated uracil) in place of an uracil of RNA). Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligomeric compound having the nucleobase sequence "ATCGATCG" encompasses any oligomeric compounds having such nucleobase sequence, whether modified or unmodified, including, but not limited to, such compounds comprising RNA bases, such as those having sequence "AUCGAUCG" and those having some DNA bases and

| Compound Number | Antisense RNAi Oligonucleotide Compound Number | Chemical Notation of Antisense RNAi Oligonucleotide (5' to 3') | SEQ ID NO | Sense RNAi oligonucleotide Compound Number | Chemical Notation of Sense RNAi Oligonucleotide (5' to 3') | SEQ ID NO |
|---|---|---|---|---|---|---|
| 1581405 | 1551732 | [VP]T$_{es}$G$_{fs}$A$_{yo}$A$_{yo}$C$_{yo}$U$_{yo}$U$_{yo}$G$_{yo}$U$_{yo}$A$_{yo}$G$_{yo}$G$_{yo}$U$_{yo}$U$_{fo}$G$_{yo}$G$_{fo}$A$_{yo}$U$_{yo}$U$_{yo}$U$_{yo}$U$_{ys}$C$_{ys}$G$_{y}$ | 3058 | 1579196 | A$_{ys}$A$_{ys}$A$_{yo}$A$_{yo}$U$_{yo}$C$_{y}$[C16muP]C$_{fo}$A$_{yo}$A$_{fo}$C$_{fo}$C$_{fo}$U$_{yo}$A$_{yo}$C$_{yo}$A$_{yo}$A$_{yo}$G$_{yo}$U$_{yo}$U$_{ys}$C$_{ys}$A$_{y}$ | 3064 |
| 1581406 | 1551735 | [VP]T$_{es}$A$_{fs}$A$_{yo}$U$_{yo}$U$_{yo}$U$_{yo}$A$_{yo}$U$_{yo}$U$_{yo}$U$_{yo}$A$_{yo}$U$_{yo}$G$_{yo}$U$_{fo}$A$_{yo}$A$_{fo}$U$_{yo}$A$_{yo}$C$_{yo}$A$_{yo}$G$_{ys}$U$_{ys}$G$_{y}$ | 3059 | 1551736 | C$_{ys}$U$_{ys}$G$_{yo}$U$_{yo}$A$_{yo}$U$_{y}$[C16muP]U$_{fo}$A$_{yo}$C$_{fo}$A$_{fo}$U$_{fo}$A$_{yo}$A$_{yo}$A$_{yo}$U$_{yo}$A$_{yo}$A$_{yo}$A$_{yo}$U$_{ys}$U$_{ys}$A$_{y}$ | 3065 |
| 1581407 | 1551737 | [VP]T$_{es}$A$_{fs}$A$_{yo}$G$_{yo}$A$_{yo}$A$_{yo}$A$_{yo}$C$_{yo}$A$_{yo}$A$_{yo}$A$_{yo}$C$_{yo}$G$_{yo}$U$_{fo}$G$_{yo}$U$_{fo}$G$_{yo}$C$_{yo}$A$_{yo}$U$_{yo}$A$_{yo}$C$_{ys}$U$_{y}$ | 3060 | 1551741 | G$_{ys}$A$_{ys}$U$_{yo}$A$_{yo}$C$_{yo}$A$_{y}$[C16muP]C$_{fo}$A$_{yo}$C$_{fo}$G$_{fo}$U$_{fo}$U$_{yo}$U$_{yo}$G$_{yo}$U$_{yo}$U$_{yo}$U$_{yo}$C$_{yo}$U$_{ys}$U$_{ys}$A$_{y}$ | 3066 |
| 1581408 | 1551739 | [VP]T$_{es}$G$_{fs}$A$_{yo}$G$_{yo}$A$_{yo}$C$_{yo}$U$_{yo}$G$_{yo}$A$_{yo}$U$_{yo}$C$_{yo}$A$_{yo}$U$_{fo}$G$_{yo}$C$_{fo}$G$_{yo}$C$_{yo}$U$_{yo}$C$_{yo}$A$_{ys}$U$_{ys}$A$_{y}$ | 3061 | 1551740 | U$_{ys}$G$_{ys}$A$_{yo}$G$_{yo}$C$_{yo}$G$_{y}$[C16muP]C$_{fo}$A$_{yo}$U$_{fo}$G$_{fo}$A$_{yo}$A$_{yo}$U$_{yo}$C$_{yo}$A$_{yo}$G$_{yo}$U$_{yo}$C$_{yo}$U$_{ys}$C$_{ys}$A$_{y}$ | 3067 |
| 1581409 | 1551742 | [VP]T$_{es}$U$_{fs}$C$_{yo}$U$_{yo}$G$_{yo}$A$_{yo}$A$_{yo}$A$_{yo}$U$_{yo}$A$_{yo}$C$_{yo}$U$_{yo}$U$_{yo}$A$_{fo}$A$_{yo}$A$_{yo}$A$_{yo}$U$_{yo}$G$_{ys}$U$_{ys}$U$_{y}$ | 3062 | 1551743 | A$_{ys}$C$_{ys}$A$_{yo}$U$_{yo}$U$_{yo}$U$_{y}$[C16muP]U$_{fo}$U$_{yo}$A$_{fo}$A$_{fo}$G$_{fo}$U$_{yo}$A$_{yo}$U$_{yo}$U$_{yo}$U$_{yo}$C$_{yo}$A$_{yo}$G$_{ys}$A$_{ys}$A$_{y}$ | 3068 |
| 1581410 | 1551744 | [VP]T$_{es}$G$_{fs}$G$_{yo}$G$_{yo}$C$_{yo}$A$_{yo}$U$_{yo}$C$_{yo}$A$_{yo}$C$_{yo}$U$_{yo}$A$_{yo}$A$_{yo}$C$_{fo}$A$_{yo}$A$_{fo}$A$_{yo}$C$_{yo}$U$_{yo}$A$_{ys}$C$_{ys}$C$_{y}$ | 3063 | 1551745 | U$_{ys}$G$_{ys}$A$_{yo}$G$_{yo}$U$_{yo}$U$_{y}$[C16muP]U$_{fo}$G$_{yo}$U$_{fo}$A$_{fo}$A$_{fo}$G$_{yo}$U$_{yo}$G$_{yo}$A$_{yo}$U$_{yo}$G$_{yo}$C$_{yo}$C$_{ys}$C$_{ys}$A$_{y}$ | 3069 |

Nonlimiting Disclosure and Incorporation by Reference

Each of the literature and patent publications listed herein is incorporated by reference in its entirety. While certain compounds, compositions and methods described herein have been described with specificity in accordance with certain embodiments, the following examples serve only to illustrate the compounds described herein and are not some RNA bases such as "AUCGATCG" and oligomeric compounds having other modified nucleobases, such as "AT$^m$CGAUCG," wherein $^m$C indicates a cytosine base comprising a methyl group at the 5-position.

Certain compounds described herein (e.g., modified oligonucleotides) have one or more asymmetric center and thus give rise to enantiomers, diastereomers, and other stereoisomeric configurations that may be defined, in terms of absolute stereochemistry, as (R) or (S), as α or β (such as for sugar anomers, or as (D) or (L), such as for amino acids, etc. Compounds provided herein that are drawn or described as having certain stereoisomeric configurations include only the indicated compounds. Compounds provided herein that are drawn or described with undefined stereochemistry include all such possible isomers, including their stereorandom and optically pure forms, unless specified otherwise. Likewise, tautomeric forms of the compounds herein are also included unless otherwise indicated. Unless otherwise indicated, compounds described herein are intended to include corresponding salt forms.

The compounds described herein include variations in which one or more atoms are replaced with a non-radioactive isotope or radioactive isotope of the indicated element. For example, compounds herein that comprise hydrogen atoms encompass all possible deuterium substitutions for each of the $^1H$ hydrogen atoms. Isotopic substitutions encompassed by the compounds herein include but are not limited to: $^2H$ or $^3H$ in place of $^1H$, $^{13}C$ or $^{14}C$ in place of $^{12}C$, $^{15}N$ in place of $^{14}N$, $^{17}O$ or $^{18}O$ in place of $^{16}O$, and $^{33}S$, $^{34}S$, $^{35}S$, or $^{36}S$ in place of $^{32}S$. In certain embodiments, non-radioactive isotopic substitutions may impart new properties on the oligomeric compound that are beneficial for use as a therapeutic or research tool. In certain embodiments, radioactive isotopic substitutions may make the compound suitable for research or diagnostic purposes such as imaging.

EXAMPLES

The following examples illustrate certain embodiments of the present disclosure and are not limiting. Moreover, where specific embodiments are provided, the inventors have contemplated generic application of those specific embodiments. For example, disclosure of an oligonucleotide having a particular motif provides reasonable support for additional oligonucleotides having the same or similar motif. And, for example, where a particular high-affinity modification appears at a particular position, other high-affinity modifications at the same position are considered suitable, unless otherwise indicated.

Example 1: Effect of Mixed Backbone 5-10-5 MOE Gapmers on Human APP In Vitro, Single Dose Modified oligonucleotides complementary to human APP nucleic acid were synthesized and tested for their effect on APP RNA levels in vitro. The modified oligonucleotides were tested in a series of experiments using the same culture conditions. The results for each separate experiment are presented in separate tables below.

The modified oligonucleotides in the tables below are 5-10-5 MOE gapmers. The gapmers are 20 nucleosides in length. The sugar motif of the gapmers is (from 5' to 3'): eeeeedddddddddddeeeee; wherein each 'd' represents a 2'-β-D-deoxyribosyl sugar moiety, and each 'e' represents a 2'-MOE sugar moiety. The internucleoside linkage motif for the gapmers is (from 5' to 3'): sooossssssssssssooss; wherein each 'o' represents a phosphodiester internucleoside linkage and each 's' represents a phosphorothioate internucleoside linkage. All cytosine nucleobases are 5-methylcytosines.

"Start site" indicates the 5'-most nucleoside of the target sequence to which the modified oligonucleotide is complementary. "Stop site" indicates the 3'-most nucleoside of the target sequence to which the modified oligonucleotide is complementary. As shown in the tables below, the modified oligonucleotides are complementary to SEQ ID NO: 1 (ENSEMBL Accession No. ENST00000346798.7 from version 94: October 2018), and/or SEQ ID NO: 2 (the complement of GENBANK Accession No. NC_000021.9, truncated from nucleotides 25878001 to 26174000). 'N/A' indicates that the modified oligonucleotide is not 100% complementary to that particular target sequence.

Cultured SH-SY5Y cells at a density of 20,000 cells per well were treated with 4,000 nM of modified oligonucleotide by electroporation. After a treatment period of approximately 24 hours, RNA was isolated from the cells and APP RNA levels were measured by quantitative real-time RTPCR. Human APP primer probe set RTS35572 (forward sequence CGGAGCAGACACAGACTATG, designated herein as SEQ ID NO: 11; reverse sequence CCTCTACCTCATCACCATCCT, designated herein as SEQ ID NO: 12; probe sequence AGTAGAAGTAGCAGAGGAGGAAGAAGTGG, designated herein as SEQ ID NO: 13) was used to measure APP RNA levels. APP RNA levels were normalized to total RNA content, as measured by RIBOGREEN®. Results are presented as percent of APP RNA, relative to untreated control cells (% UTC). The values marked by the symbol "f" indicate that the modified oligonucleotide is complementary to the amplicon region of the primer probe set. Additional assays may be used to measure the activity of the modified oligonucleotides complementary to the amplicon region.

TABLE 1

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1353644 | N/A | N/A | 273926 | 273945 | GGTTAAGTTTCAACTCATTC | 24 | 30 |
| 1353648 | N/A | N/A | 76445 | 76464 | CCTTTCAATATTGTTCTTCC | 26 | 31 |
| 1353653 | N/A | N/A | 96474 | 96493 | GCCTCATTTTCTATGCATCC | 15 | 32 |
| 1353666 | N/A | N/A | 233346 | 233365 | TGCATCAATTCCTTTGGGTT | 25 | 33 |
| 1353674 | N/A | N/A | 107660 | 107679 | ACACTCTTTGCTTACCCACT | 35 | 34 |
| 1353677 | 2919 | 2938 | 292903 | 292922 | CGTGTGTATCCTCTTAATTC | 25 | 35 |

TABLE 1-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1353685 | N/A | N/A | 282274 | 282293 | TCAAGTTTACCTACCTCCAC | 98 | 36 |
| 1353688 | N/A | N/A | 219303 | 219322 | TGTGTCATAACCTGCATCAA | 61† | 37 |
| 1353689 | N/A | N/A | 219394 | 219413 | ACCAACTTCATCCTGAATCT | 57 | 38 |
| 1353692 | N/A | N/A | 27291 | 27310 | AGCGCACTATTCTCTCTTGT | 26 | 39 |
| 1353694 | N/A | N/A | 153323 | 153342 | AGTACATATTCATTCAATCT | 32 | 40 |
| 1353696 | N/A | N/A | 91426 | 91445 | TACTACTCTTATCATGACCA | 26 | 41 |
| 1353708 | N/A | N/A | 4669 | 4688 | AATTCGATCCTTTTATCTGC | 48 | 42 |
| 1353721 | N/A | N/A | 199217 | 199236 | CCATCAATTGTCACCACCTC | 31 | 43 |
| 1353722 | N/A | N/A | 176809 | 176828 | CCCAACATCTCAAGCTGTCT | 32 | 44 |
| 1353727 | N/A | N/A | 184663 | 184682 | GAGCACTCCATTTCATATTC | 32 | 45 |
| 1353732 | N/A | N/A | 163515 | 163534 | TGGTTATCTACAATGTGCAA | 39 | 46 |
| 1353737 | N/A | N/A | 238508 | 238527 | GTCACACTATACTTTGTTAT | 24 | 47 |
| 1353739 | N/A | N/A | 152153 | 152172 | TGGTGGATTACCTCGAACCA | 75 | 48 |
| 1353741 | N/A | N/A | 105867 | 105886 | TTTCACATACCATACTCAGA | 51 | 49 |
| 1353745 | N/A | N/A | 84230 | 84249 | GAACTCAAAAATACTGCTCC | 49 | 50 |
| 1353754 | N/A | N/A | 224770 | 224789 | GACACTTGAAAATTCACACT | 23 | 51 |
| 1353788 | 967 | 986 | 173886 | 173905 | GGGCACACTTCCCTTCAGTC | 36 | 52 |
| 1353789 | N/A | N/A | 53100 | 53119 | TGCAAATTTCATCACCAAAC | 66 | 53 |
| 1353793 | N/A | N/A | 219398 | 219417 | ACTTACCAACTTCATCCTGA | 81 | 54 |
| 1353802 | N/A | N/A | 208597 | 208616 | TTTGCATATTCATACTTGGA | 26 | 55 |
| 1353803 | N/A | N/A | 33641 | 33660 | ATGTCAACACTAACCCAACT | 59 | 56 |
| 1353807 | N/A | N/A | 33840 | 33859 | TACTCACTTACATAGTTGAT | 38 | 57 |
| 1353834 | N/A | N/A | 276227 | 276246 | CCAAAACTTCTTTCTAGGCC | 33 | 58 |
| 1353837 | N/A | N/A | 158880 | 158899 | GTTCTCTCTAAATATCAGCT | 28 | 59 |
| 1353838 | 388 | 407 | 120651 | 120670 | CACTTACAAACTCACCAACT | 44 | 60 |
| 1353843 | N/A | N/A | 62013 | 62032 | CAGGACTTACTTCTTGGCAA | 70 | 61 |
| 1353846 | 1179 | 1198 | 191578 | 191597 | ATGTTCATTCTCATCCCCAG | 37 | 62 |
| 1353855 | N/A | N/A | 56176 | 56195 | GCCACTATTTGCTACACAAT | 44 | 63 |
| 1353858 | N/A | N/A | 84581 | 84600 | TCAGACTGTTTCCTCCAGTT | 33 | 64 |
| 1353867 | N/A | N/A | 228779 | 228798 | GCATGCTAAATCAGTTCTCT | 22 | 65 |
| 1353869 | N/A | N/A | 281988 | 282007 | GTTTCAGTATATTCTCTGCC | 40 | 66 |
| 1353871 | N/A | N/A | 164097 | 164116 | GCCAGAATGTACTTCCTTAT | 37 | 67 |
| 1353874 | N/A | N/A | 195929 | 195948 | TCCATTTTACCTCATACACT | 50 | 68 |
| 1353878 | N/A | N/A | 288816 | 288835 | GGATCTTTAATCTCCAGCCC | 37 | 69 |
| 1353879 | N/A | N/A | 281184 | 281203 | ACCACAACTTTTATCATCTT | 38 | 70 |

TABLE 1-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1353888 | N/A | N/A | 132424 | 132443 | CCTACAGTATTTCTCATTCA | 51 | 71 |
| 1353889 | N/A | N/A | 93552 | 93571 | GCTCATTTTTTTACATGAC | 8 | 72 |
| 1353891 | N/A | N/A | 19936 | 19955 | AAGCTTTCCACATTTGCTTA | 66 | 73 |
| 1353897 | N/A | N/A | 105713 | 105732 | CAACAATCTGCAACTCTTCT | 62 | 74 |
| 1353899 | N/A | N/A | 167731 | 167750 | GTTGAATTTCTTACACTTTC | 8 | 75 |
| 1353901 | N/A | N/A | 123282 | 123301 | CGCCATTATTATTTCAACTC | 17 | 76 |
| 1353910 | 633 | 652 | 122938 | 122957 | CGAGTCATCCTCCTCCGCAT | 17 | 77 |
| 1353923 | N/A | N/A | 260567 | 260586 | CCCTCATTAGATTTCCTCCA | 47 | 78 |
| 1353943 | N/A | N/A | 216405 | 216424 | CCATGATGTTCCTTCCTGGC | 34 | 79 |
| 1353947 | N/A | N/A | 266304 | 266323 | TGAGTCTGTTACTTCTGGTA | 28 | 80 |
| 1353949 | N/A | N/A | 33701 | 33720 | GCAGTGACCACAACTTGACC | 63 | 81 |
| 1353951 | 1861 | 1880 | 262178 | 262197 | CCAGGCTGAACTCTCCATTC | 51 | 82 |
| 1353952 | 577 | 596 | 122882 | 122901 | GGCAACACACAAACTCTACC | 35 | 83 |
| 1353969 | N/A | N/A | 10486 | 10505 | TGTCCTATTTATTCCTCATC | 23 | 84 |
| 1353978 | N/A | N/A | 88026 | 88045 | TTGTAATTCCTTTTTTGGAT | 18 | 85 |
| 1353989 | N/A | N/A | 4688 | 4707 | TCCGTCTTAATCTTCACTCA | 20 | 86 |
| 1353993 | N/A | N/A | 25097 | 25116 | TACATCATTTTCTTGCAGTC | 30 | 87 |
| 1353996 | N/A | N/A | 8728 | 8747 | TCATCACCATACATAGCAGC | 37 | 88 |
| 1354004 | N/A | N/A | 219408 | 219427 | AGAACAGCTTACTTACCAAC | 111 | 89 |
| 1354005 | N/A | N/A | 141474 | 141493 | ATGAACATGTCACTTAGGCT | 48 | 90 |
| 1354007 | N/A | N/A | 104230 | 104249 | TGGTCTATATATTTCAGGCA | 11 | 91 |
| 1354019 | N/A | N/A | 68525 | 68544 | GTATTCTTTTCCTTGCCGTT | 35 | 92 |
| 1354022 | N/A | N/A | 41389 | 41408 | TCTGCTTTATTACTTGGATA | 32 | 93 |
| 1354025 | 449 | 468 | 120712 | 120731 | TCGCAAACATCCATCCTCTC | 27 | 94 |
| 1354029 | N/A | N/A | 180345 | 180364 | GCTGACATTCTAACATTTCA | 24 | 95 |
| 1354032 | 2156 | 2175 | 282190 | 282209 | GTCGCTATGACAACACCGCC | 42 | 96 |
| 1354051 | N/A | N/A | 105744 | 105763 | CTTTCCAACCTATTACCATC | 50 | 97 |
| 1354055 | N/A | N/A | 15616 | 15635 | ACTGTATTTCTTCTACATCC | 21 | 98 |
| 1354070 | N/A | N/A | 130151 | 130170 | GCTGATATTCTCACTTTATC | 102 | 99 |
| 1354078 | 2592 | 2611 | 292576 | 292595 | ACAGCTAAATTCTTTACAGT | 34 | 100 |
| 1354080 | N/A | N/A | 120580 | 120599 | ACCGCAGAAGACATCAAGGA | 66 | 101 |
| 1354086 | N/A | N/A | 116604 | 116623 | TCATCAATATACAGTATGCA | 38 | 102 |
| 1354089 | N/A | N/A | 33628 | 33647 | CCCAACTTCTACCACGCACA | 56 | 103 |
| 1354091 | 3246 | 3265 | 293230 | 293249 | ACTTCGATTATTTAATGTCT | 57 | 104 |
| 1354097 | N/A | N/A | 49650 | 49669 | TTCAACTTGTCCACGGACTT | 40 | 105 |

TABLE 1-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354099 | N/A | N/A | 35914 | 35933 | ATGTACTAATATCCAGTGGC | 33 | 106 |
| 1354101 | 2033 | 2052 | 276363 | 276382 | GCATCCATCTTCACTTCAGA | 48 | 107 |

TABLE 2

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1353637 | N/A | N/A | 244555 | 244574 | CGTCTCTTTATCACTTTACT | 23 | 108 |
| 1353639 | N/A | N/A | 54257 | 54276 | GCTCAATTTGCACAAATCTC | 29 | 109 |
| 1353643 | N/A | N/A | 98612 | 98631 | GCACAATTATTGTTTCCTCT | 16 | 110 |
| 1353645 | N/A | N/A | 25100 | 25119 | GCTTACATCATTTTCTTGCA | 15 | 111 |
| 1353646 | N/A | N/A | 171484 | 171503 | GTGTACATATTCATGTCACA | 39 | 112 |
| 1353649 | N/A | N/A | 124113 | 124132 | TGGTACTATTTCTAAGGAAT | 41 | 113 |
| 1353656 | N/A | N/A | 107667 | 107686 | TTGTAAGACACTCTTTGCTT | 46 | 114 |
| 1353658 | N/A | N/A | 85021 | 85040 | AGGACATTCATTTTTGACCA | 27 | 115 |
| 1353668 | N/A | N/A | 9636 | 9655 | GTGAACATAACTTCAAGCTT | 28 | 116 |
| 1353672 | N/A | N/A | 33633 | 33652 | ACTAACCCAACTTCTACCAC | 65 | 117 |
| 1353676 | N/A | N/A | 33719 | 33738 | ATCAACAAACTGTTAACTGC | 62 | 118 |
| 1353680 | 2621 | 2640 | 292605 | 292624 | GAGAGAATCTATTCATGCAC | 50 | 119 |
| 1353684 | N/A | N/A | 165830 | 165849 | GCCAATACATCTGTCATTCT | 48 | 120 |
| 1353691 | N/A | N/A | 211612 | 211631 | ATGTATTTCTACCTCTAGGC | 38 | 121 |
| 1353700 | N/A | N/A | 105772 | 105791 | ACTGTCACTCTCACGCCCCT | 65 | 122 |
| 1353702 | N/A | N/A | 164083 | 164102 | CCTTATACCACTTCTCTGTA | 58 | 123 |
| 1353719 | 453 | 472 | 120716 | 120735 | AGTTTCGCAAACATCCATCC | 76 | 124 |
| 1353724 | N/A | N/A | 105679 | 105698 | CAACAAATGCCATCAGTCTC | 72 | 125 |
| 1353726 | N/A | N/A | 152368 | 152387 | GCAGCATATACAAGGTACAA | 34 | 126 |
| 1353735 | 2157 | 2176 | 282191 | 282210 | TGTCGCTATGACAACACCGC | 51 | 127 |
| 1353768 | N/A | N/A | 120603 | 120622 | TCCATCTGTATCACAGTGTT | 74 | 128 |
| 1353769 | N/A | N/A | 219401 | 219420 | CTTACTTACCAACTTCATCC | 91 | 129 |
| 1353770 | N/A | N/A | 267413 | 267432 | TCTAGTATTTCACTAGTGCA | 33 | 130 |
| 1353772 | N/A | N/A | 116757 | 116776 | TTGCTTTGATCTTTCAGGTA | 41 | 131 |
| 1353775 | N/A | N/A | 281221 | 281240 | TTCAACTTTATCTACTTGAA | 64 | 132 |
| 1353782 | N/A | N/A | 15618 | 15637 | GTACTGTATTTCTTCTACAT | 40 | 133 |
| 1353784 | N/A | N/A | 181088 | 181107 | ACTAACATTTGCTACTGCAC | 48 | 134 |

TABLE 2-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1353787 | N/A | N/A | 94504 | 94523 | GTTCACATTTCAGACCACCA | 58 | 135 |
| 1353795 | N/A | N/A | 189342 | 189361 | ACTTGCATTTCAAGTTCCCA | 56 | 136 |
| 1353812 | N/A | N/A | 178219 | 178238 | GCAGCAGTACAAACCACATC | 47 | 137 |
| 1353823 | N/A | N/A | 62014 | 62033 | ACAGGACTTACTTCTTGGCA | 85 | 138 |
| 1353826 | N/A | N/A | 84268 | 84287 | TTCAATATACACCCTGGGTA | 33 | 139 |
| 1353833 | N/A | N/A | 6224 | 6243 | GACCAGTATTATTCCATCTA | 17 | 140 |
| 1353849 | N/A | N/A | 28032 | 28051 | GCTCTCATAATATCCTCATC | 19 | 141 |
| 1353852 | N/A | N/A | 228352 | 228371 | CCCATATTATCTATGGACAA | 30 | 142 |
| 1353854 | 2064 | 2083 | 276394 | 276413 | AACTTCATATCCTGAGTCAT | 72 | 143 |
| 1353857 | N/A | N/A | 289147 | 289166 | GTCAACAATCATTTGCATGC | 61 | 144 |
| 1353872 | N/A | N/A | 174425 | 174444 | TACACCTTATCAATGCAACT | 62 | 145 |
| 1353880 | N/A | N/A | 72154 | 72173 | TCTACCTTTGCAATTTTCTA | 91 | 146 |
| 1353882 | N/A | N/A | 274063 | 274082 | GGACAGTTTCCCTTTCTCAT | 39 | 147 |
| 1353886 | N/A | N/A | 44381 | 44400 | GCACAAATTTTATCACATCC | 23 | 148 |
| 1353893 | N/A | N/A | 134374 | 134393 | GCCTACTATATGCTCAACAT | 60 | 149 |
| 1353896 | N/A | N/A | 50552 | 50571 | AGATTACTTCTTTTCCTGCA | 61 | 150 |
| 1353908 | 579 | 598 | 122884 | 122903 | TGGGCAACACACAAACTCTA | 34 | 151 |
| 1353917 | N/A | N/A | 262696 | 262715 | CCACACATTTTCCTTGTGAA | 21 | 152 |
| 1353926 | 3247 | 3266 | 293231 | 293250 | TACTTCGATTATTTAATGTC | 85 | 153 |
| 1353928 | N/A | N/A | 141829 | 141848 | GTGAGCTAACATTTTTCCTC | 40 | 154 |
| 1353934 | N/A | N/A | 57149 | 57168 | TGGTACTTTTTAATCAGTTC | 31 | 155 |
| 1353945 | N/A | N/A | 92733 | 92752 | AGTTACTGTCACAACAAGGC | 36 | 156 |
| 1353950 | 1181 | 1200 | 191580 | 191599 | GCATGTTCATTCTCATCCCC | 27 | 157 |
| 1353954 | N/A | N/A | 105868 | 105887 | TTTTCACATACCATACTCAG | 60 | 158 |
| 1353955 | N/A | N/A | 203618 | 203637 | CCATCAATGTCCATTTAGCA | 53 | 159 |
| 1353958 | 3127 | 3146 | 293111 | 293130 | GTACAATCATCCTGCAGAAA | 44 | 160 |
| 1353961 | N/A | N/A | 276228 | 276247 | CCCAAAACTTCTTTCTAGGC | 38 | 161 |
| 1353974 | N/A | N/A | 130297 | 130316 | CCAAGTATTTTCCTGCATCA | 31 | 162 |
| 1353986 | N/A | N/A | 38386 | 38405 | GCCTTATTATCTCAAACTCA | 38 | 163 |
| 1353991 | N/A | N/A | 260987 | 261006 | GTCTCATTTTCCAATCATAG | 35 | 164 |
| 1353995 | N/A | N/A | 33841 | 33860 | GTACTCACTTACATAGTTGA | 58 | 165 |
| 1354001 | N/A | N/A | 154231 | 154250 | CTGTAATTTGTATTCACACT | 23 | 166 |
| 1354006 | 1697 | 1716 | 219387 | 219406 | TCATCCTGAATCTCCTCGGC | 70 | 167 |
| 1354008 | N/A | N/A | 216780 | 216799 | GCAACTTATTACAACTCTCA | 43 | 168 |
| 1354013 | N/A | N/A | 4672 | 4691 | CTCAATTCGATCCTTTTATC | 64 | 169 |
| 1354018 | N/A | N/A | 33644 | 33663 | AGCATGTCAACACTAACCCA | 42 | 170 |

TABLE 2-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354020 | N/A | N/A | 225511 | 225530 | CCATATCTTTCAATCCTGCC | 37 | 171 |
| 1354023 | 389 | 408 | 120652 | 120671 | TCACTTACAAACTCACCAAC | 62 | 172 |
| 1354030 | N/A | N/A | 220662 | 220681 | GCCAAATATTTCACAGCAAT | 10 | 173 |
| 1354037 | 635 | 654 | 122940 | 122959 | TCCGAGTCATCCTCCTCCGC | 22 | 174 |
| 1354041 | N/A | N/A | 10520 | 10539 | AGGCTTATTCATCTTTTCCC | 26 | 175 |
| 1354042 | N/A | N/A | 84113 | 84132 | ACAGGAGCATCCTCTTTTTC | 69 | 176 |
| 1354056 | N/A | N/A | 282275 | 282294 | GTCAAGTTTACCTACCTCCA | 115 | 177 |
| 1354057 | N/A | N/A | 158958 | 158977 | GCAGATATTTCAATATACAG | 14 | 178 |
| 1354061 | N/A | N/A | 105719 | 105738 | TTGCTCCAACAATCTGCAAC | 64 | 179 |
| 1354069 | N/A | N/A | 282128 | 282147 | TTCTGCAAAGAACACCTTGA | 68 | 180 |
| 1354075 | N/A | N/A | 229318 | 229337 | TTGGATTCATCTCCATACTC | 34 | 181 |
| 1354092 | N/A | N/A | 88105 | 88124 | TGGTCATTACTACTTACACA | 46 | 182 |
| 1354093 | N/A | N/A | 197708 | 197727 | TTGGTCTTTTTTTACCCCGA | 31 | 183 |
| 1354094 | N/A | N/A | 233418 | 233437 | AACTAATTATCAGATATGCA | 52 | 184 |
| 1354098 | N/A | N/A | 19938 | 19957 | GTAAGCTTTCCACATTTGCT | 58 | 185 |

TABLE 3

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1353636 | 3338 | 3357 | 293322 | 293341 | GCCACTTCCATTTTCATCTT | 53 | 186 |
| 1353640 | 2199 | 2218 | 282233 | 282252 | GTACTGTTTCTTCTTCAGCA | 29 | 187 |
| 1353642 | N/A | N/A | 230836 | 230855 | GCATCATATATATACTTCTT | 29 | 188 |
| 1353647 | N/A | N/A | 22819 | 22838 | TTTGACTTGTTTTTCACCAC | 16 | 189 |
| 1353651 | N/A | N/A | 175225 | 175244 | GTAGTTCATACTTCCTACTC | 26 | 190 |
| 1353675 | 2106 | 2125 | 282140 | 282159 | TGAACCCACATCTTCTGCAA | 54 | 191 |
| 1353682 | N/A | N/A | 282318 | 282337 | GCCTAATTCTCTCATAGTCT | 20 | 192 |
| 1353683 | N/A | N/A | 212180 | 212199 | TGTCACAATATTCATACTTA | 22 | 193 |
| 1353699 | N/A | N/A | 225514 | 225533 | CCGCCATATCTTTCAATCCT | 31 | 194 |
| 1353703 | N/A | N/A | 33757 | 33776 | TTGTCAATTACATCAGCAAC | 26 | 195 |
| 1353705 | 3129 | 3148 | 293113 | 293132 | CTGTACAATCATCCTGCAGA | 30 | 196 |
| 1353706 | N/A | N/A | 95358 | 95377 | CTACAATTATCCACATGGCA | 24 | 197 |
| 1353717 | N/A | N/A | 38467 | 38486 | AGTCACTCAAACTTTGATTT | 39 | 198 |
| 1353718 | N/A | N/A | 72172 | 72191 | TCCAATTTGCAACCTCATTC | 36 | 199 |

TABLE 3-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1353731 | N/A | N/A | 159559 | 159578 | GCATTCATTCTATTTGGTGC | 11 | 200 |
| 1353733 | N/A | N/A | 11253 | 11272 | GCAACAGATCTCTTATTCTC | 16 | 201 |
| 1353736 | N/A | N/A | 9637 | 9656 | GGTGAACATAACTTCAAGCT | 13 | 202 |
| 1353740 | N/A | N/A | 172804 | 172823 | CACATCTTACCTGTCAACAT | 55 | 203 |
| 1353760 | N/A | N/A | 146928 | 146947 | CGGACTTTTTCTTCTTGCT | 39 | 204 |
| 1353763 | N/A | N/A | 131534 | 131553 | CACCATCTATAATACCATCT | 25 | 205 |
| 1353773 | N/A | N/A | 105776 | 105795 | GTAGACTGTCACTCTCACGC | 32 | 206 |
| 1353774 | 2066 | 2085 | 276396 | 276415 | TGAACTTCATATCCTGAGTC | 53 | 207 |
| 1353777 | N/A | N/A | 15647 | 15666 | GTCTACCCATTTTCCTCTAT | 44 | 208 |
| 1353778 | N/A | N/A | 105680 | 105699 | ACAACAAATGCCATCAGTCT | 50 | 209 |
| 1353779 | N/A | N/A | 246007 | 246026 | TGCTGATCTGATTTCCAACT | 27 | 210 |
| 1353794 | N/A | N/A | 85151 | 85170 | GTTTTCTACACTCTCTTCAT | 42 | 211 |
| 1353796 | N/A | N/A | 126055 | 126074 | GTCACATGATATTTCAGATA | 21 | 212 |
| 1353797 | N/A | N/A | 153108 | 153127 | TTCACAATATTTGCAACACA | 23 | 213 |
| 1353798 | N/A | N/A | 181220 | 181239 | CCATCACATCTTTTAATGCT | 53 | 214 |
| 1353800 | 638 | 657 | 122943 | 122962 | ACATCCGAGTCATCCTCCTC | 29 | 215 |
| 1353801 | N/A | N/A | 228353 | 228372 | ACCCATATTATCTATGGACA | 21 | 216 |
| 1353804 | N/A | N/A | 191874 | 191893 | GACATCATTTAATTTGTGCT | 24 | 217 |
| 1353811 | N/A | N/A | 268185 | 268204 | ACAGCATGATATTCCTCACC | 33 | 218 |
| 1353817 | N/A | N/A | 154489 | 154508 | GTTCACATTTCTTACAACAC | 25 | 219 |
| 1353819 | N/A | N/A | 33843 | 33862 | CAGTACTCACTTACATAGTT | 41 | 220 |
| 1353820 | 1701 | 1720 | 219391 | 219410 | AACTTCATCCTGAATCTCCT | 32 | 221 |
| 1353822 | N/A | N/A | 204992 | 205011 | GTGATCTTTTTCAGACAACC | 22 | 222 |
| 1353827 | N/A | N/A | 33634 | 33653 | CACTAACCCAACTTCTACCA | 67 | 223 |
| 1353831 | N/A | N/A | 6792 | 6811 | GTACATTCCACTTTGTTTTA | 24 | 224 |
| 1353841 | N/A | N/A | 54387 | 54406 | GTTGACATATACCTACCTAT | 64 | 225 |
| 1353842 | N/A | N/A | 165834 | 165853 | GCTAGCCAATACATCTGTCA | 54 | 226 |
| 1353847 | N/A | N/A | 222140 | 222159 | GTTTCAACTATATTCCTACT | 25 | 227 |
| 1353850 | 2487 | 2506 | 292471 | 292490 | TCAGGCATCTACTTGTGTTA | 26 | 228 |
| 1353864 | N/A | N/A | 164084 | 164103 | TCCTTATACCACTTCTCTGT | 38 | 229 |
| 1353866 | N/A | N/A | 29351 | 29370 | TGGTCAATTCTCTTGAACAA | 30 | 230 |
| 1353875 | N/A | N/A | 45571 | 45590 | TGGTTCATTTCTTTAGCCAC | 14 | 231 |
| 1353883 | N/A | N/A | 105738 | 105757 | AACCTATTACCATCTGGCCT | 54 | 232 |
| 1353887 | N/A | N/A | 121258 | 121277 | AGCTACTTCACTGTTCTACC | 52 | 233 |
| 1353898 | N/A | N/A | 117352 | 117371 | CTGAACTTTCTAACTTGCAA | 58 | 234 |
| 1353900 | 600 | 619 | 122905 | 122924 | ATTGTCACTTTCTTCAGCCA | 27 | 235 |

TABLE 3-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1353905 | N/A | N/A | 63454 | 63473 | GTTCATACTCCTTTCAAGAT | 33 | 236 |
| 1353907 | N/A | N/A | 33646 | 33665 | ACAGCATGTCAACACTAACC | 60 | 237 |
| 1353913 | N/A | N/A | 178598 | 178617 | ATGTGATTTCACTAACCGGC | 13 | 238 |
| 1353914 | N/A | N/A | 134530 | 134549 | GCTTGAATTACTATTGATCT | 23 | 239 |
| 1353932 | 1313 | 1332 | 198027 | 198046 | TGGATAACTGCCTTCTTATC | 38 | 240 |
| 1353933 | N/A | N/A | 274949 | 274968 | GCACCATTTCCTCATCCAAT | 27 | 241 |
| 1353935 | N/A | N/A | 50739 | 50758 | GTGCTTATAACTCTCATACT | 26 | 242 |
| 1353946 | N/A | N/A | 219402 | 219421 | GCTTACTTACCAACTTCATC | 75 | 243 |
| 1353959 | N/A | N/A | 92773 | 92792 | GTTTCTTTACCCACATCTTC | 18 | 244 |
| 1353967 | N/A | N/A | 217227 | 217246 | GTTGTGTTATCCATATCCTA | 24 | 245 |
| 1353977 | N/A | N/A | 25101 | 25120 | AGCTTACATCATTTTCTTGC | 27 | 246 |
| 1353980 | N/A | N/A | 108206 | 108225 | ACTGCACTATTAGTCATATC | 37 | 247 |
| 1353981 | N/A | N/A | 281265 | 281284 | GCACTACATTGCTTCATACT | 50 | 248 |
| 1353982 | N/A | N/A | 263016 | 263035 | TCCTTATTTCACTATCTATC | 51 | 249 |
| 1353983 | N/A | N/A | 105869 | 105888 | GTTTTCACATACCATACTCA | 45 | 250 |
| 1353984 | N/A | N/A | 261096 | 261115 | GTCTTCTCTTATGTCACCAA | 28 | 251 |
| 1353985 | 390 | 409 | 120653 | 120672 | ATCACTTACAAACTCACCAA | 39 | 252 |
| 1353990 | N/A | N/A | 233550 | 233569 | AGTTCCTTTTCACCTATCCT | 34 | 253 |
| 1353992 | N/A | N/A | 84177 | 84196 | GTCCAAAACACAGTACAACA | 17 | 254 |
| 1354015 | N/A | N/A | 98830 | 98849 | GGCTACATCCTCAATTCATT | 32 | 255 |
| 1354045 | N/A | N/A | 276282 | 276301 | CAGGACAACCAATTAGTTTT | 78 | 256 |
| 1354048 | N/A | N/A | 88860 | 88879 | CCGGACATGTTTTCTTTTAC | 18 | 257 |
| 1354052 | N/A | N/A | 84273 | 84292 | GTAATTTCAATATACACCCT | 17 | 258 |
| 1354076 | 2671 | 2690 | 292655 | 292674 | CCACAAGAATAATATACAAC | 50 | 259 |
| 1354087 | N/A | N/A | 120611 | 120630 | CCCGTCATTCCATCTGTATC | 84 | 260 |
| 1354095 | N/A | N/A | 4674 | 4693 | CACTCAATTCGATCCTTTTA | 44 | 261 |
| 1354102 | N/A | N/A | 189857 | 189876 | GCTTAATACATCCTGTTCAA | 46 | 262 |
| 1354103 | N/A | N/A | 59208 | 59227 | ACAGCTATTTAATGTCATC | 57 | 263 |

TABLE 4

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1353650 | 645 | 664 | 122950 | 122969 | CCACCAGACATCCGAGTCAT | 59 | 264 |
| 1353652 | N/A | N/A | 246441 | 246460 | GCTACACTATCAATCTTGAA | 64 | 265 |

TABLE 4-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1353659 | 3341 | 3360 | 293325 | 293344 | ATTGCCACTTCCATTTTCAT | 54 | 266 |
| 1353662 | N/A | N/A | 179244 | 179263 | GCTTGCTTACCTTCTAGTTC | 39 | 267 |
| 1353667 | N/A | N/A | 33648 | 33667 | CAACAGCATGTCAACACTAA | 65 | 268 |
| 1353669 | N/A | N/A | 230837 | 230856 | AGCATCATATATATACTTCT | 33 | 269 |
| 1353670 | N/A | N/A | 219393 | 219412 | CCAACTTCATCCTGAATCTC | 69 | 270 |
| 1353678 | N/A | N/A | 276283 | 276302 | GCAGGACAACCAATTAGTTT | 50 | 271 |
| 1353681 | N/A | N/A | 153293 | 153312 | GCATCTTTTACTATCTGCCA | 21 | 272 |
| 1353686 | N/A | N/A | 12586 | 12605 | GCATTCTCTTATATTCCTTA | 19 | 273 |
| 1353693 | 602 | 621 | 122907 | 122926 | ACATTGTCACTTTCTTCAGC | 43 | 274 |
| 1353698 | N/A | N/A | 282270 | 282289 | GTTTACCTACCTCCACCACA | 93 | 275 |
| 1353716 | 396 | 415 | 120659 | 120678 | AAGGGCATCACTTACAAACT | 38 | 276 |
| 1353720 | N/A | N/A | 164092 | 164111 | AATGTACTTCCTTATACCAC | 31 | 277 |
| 1353742 | N/A | N/A | 128791 | 128810 | GGCTATATTCTCTCTTCAAT | 23 | 278 |
| 1353746 | N/A | N/A | 219403 | 219422 | AGCTTACTTACCAACTTCAT | 95 | 279 |
| 1353748 | N/A | N/A | 281269 | 281288 | TACTGCACTACATTGCTTCA | 70 | 280 |
| 1353750 | N/A | N/A | 101643 | 101662 | CCGGATTATTTCACATTCTC | 13 | 281 |
| 1353752 | N/A | N/A | 284992 | 285011 | GGATTCTTTTTCCTTAGGTC | 21 | 282 |
| 1353766 | N/A | N/A | 206318 | 206337 | CAGGACATATCATCATCTTC | 40 | 283 |
| 1353767 | N/A | N/A | 193342 | 193361 | ATTGTTATTCATCTTAAGGC | 28 | 284 |
| 1353771 | N/A | N/A | 263075 | 263094 | GTCAAATCTGCATCTCTGCA | 41 | 285 |
| 1353781 | N/A | N/A | 112542 | 112561 | ATGTGCTCATTATATGCTAT | 44 | 286 |
| 1353785 | 2721 | 2740 | 292705 | 292724 | CCCATCGATTCTTAAAGCAT | 29 | 287 |
| 1353786 | N/A | N/A | 84275 | 84294 | TTGTAATTTCAATATACACC | 34 | 288 |
| 1353790 | N/A | N/A | 33844 | 33863 | ACAGTACTCACTTACATAGT | 48 | 289 |
| 1353806 | N/A | N/A | 160206 | 160225 | GTCTCATCACATTTTAAGCA | 32 | 290 |
| 1353808 | N/A | N/A | 271068 | 271087 | ACATCATATTCTTACTGTTA | 30 | 291 |
| 1353818 | N/A | N/A | 146929 | 146948 | ACGGACTTTTTCTTCTTGC | 57 | 292 |
| 1353824 | N/A | N/A | 105858 | 105877 | CCATACTCAGAAAGCCATGT | 64 | 293 |
| 1353825 | N/A | N/A | 262031 | 262050 | GAAGCAGCTCATCTAAACCA | 74 | 294 |
| 1353830 | N/A | N/A | 17037 | 17056 | AACAACTATTTGAGACATGC | 15 | 295 |
| 1353832 | N/A | N/A | 22918 | 22937 | AGCAGCATTTCATCACAATT | 23 | 296 |
| 1353835 | N/A | N/A | 38724 | 38743 | GCACCAGACCTTCTCACTTC | 42 | 297 |
| 1353840 | N/A | N/A | 276076 | 276095 | GCCTTTAAATACATGCTATA | 62 | 298 |
| 1353844 | N/A | N/A | 226497 | 226516 | CCGTACTTTGCCATTCATTT | 32 | 299 |
| 1353859 | N/A | N/A | 228354 | 228373 | AACCCATATTATCTATGGAC | 34 | 300 |
| 1353863 | 2589 | 2608 | 292573 | 292592 | GCTAAATTCTTTACAGTACA | 38 | 301 |

TABLE 4-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1353865 | N/A | N/A | 84222 | 84241 | AAATACTGCTCCTATAGGGT | 59 | 302 |
| 1353873 | N/A | N/A | 4679 | 4698 | ATCTTCACTCAATTCGATCC | 56 | 303 |
| 1353885 | N/A | N/A | 33637 | 33656 | CAACACTAACCCAACTTCTA | 90 | 304 |
| 1353890 | N/A | N/A | 33764 | 33783 | CCAATCATTGTCAATTACAT | 30 | 305 |
| 1353902 | N/A | N/A | 198341 | 198360 | TTCTCATAATTTTTGCTGGA | 60 | 306 |
| 1353903 | N/A | N/A | 234566 | 234585 | TCCCACTTAATTTTTCATCC | 21 | 307 |
| 1353906 | N/A | N/A | 105872 | 105891 | GCTGTTTTCACATACCATAC | 29 | 308 |
| 1353909 | N/A | N/A | 166805 | 166824 | TTGAACTCTTTTTCTCCAAT | 35 | 309 |
| 1353920 | N/A | N/A | 105739 | 105758 | CAACCTATTACCATCTGGCC | 90 | 310 |
| 1353922 | N/A | N/A | 190594 | 190613 | AGGTTATTCAAATATCACCA | 27 | 311 |
| 1353936 | N/A | N/A | 105681 | 105700 | AACAACAAATGCCATCAGTC | 49 | 312 |
| 1353937 | N/A | N/A | 6794 | 6813 | TAGTACATTCCACTTTGTTT | 22 | 313 |
| 1353938 | N/A | N/A | 120616 | 120635 | CACTTCCCGTCATTCCATCT | 85 | 314 |
| 1353940 | N/A | N/A | 121799 | 121818 | GCTAGATCAGATTTCTCAAC | 54 | 315 |
| 1353942 | N/A | N/A | 30248 | 30267 | CCCTTCTACTCTTGTTTCCA | 41 | 316 |
| 1353948 | N/A | N/A | 175488 | 175507 | GGAGCTTTTCCATTACATTC | 31 | 317 |
| 1353957 | N/A | N/A | 51568 | 51587 | TCATATTGTCTTCAATGTGC | 23 | 318 |
| 1353963 | N/A | N/A | 54402 | 54421 | TCTAGTTTTTCAACAGTTGA | 59 | 319 |
| 1353968 | 1509 | 1528 | 218262 | 218281 | GACATACTTCTTTAGCATAT | 38 | 320 |
| 1353972 | N/A | N/A | 10233 | 10252 | CGTTCATCATCATTTAACCA | 23 | 321 |
| 1353979 | 2067 | 2086 | 276397 | 276416 | ATGAACTTCATATCCTGAGT | 64 | 322 |
| 1354003 | 2107 | 2126 | 282141 | 282160 | TTGAACCCACATCTTCTGCA | 56 | 323 |
| 1354011 | N/A | N/A | 59242 | 59261 | TTTCACTTTGTCATCCTCCC | 52 | 324 |
| 1354016 | N/A | N/A | 46440 | 46459 | TCCATCACTGTCTATATCTC | 49 | 325 |
| 1354021 | N/A | N/A | 92842 | 92861 | CACCATATTACTTATGCACC | 17 | 326 |
| 1354026 | 3134 | 3153 | 293118 | 293137 | TGATTCTGTACAATCATCCT | 39 | 327 |
| 1354034 | N/A | N/A | 117357 | 117376 | GGTTACTGAACTTTCTAACT | 45 | 328 |
| 1354036 | N/A | N/A | 26673 | 26692 | TCAGAATTCACTTGACATGC | 56 | 329 |
| 1354038 | N/A | N/A | 86229 | 86248 | AGGTCATTAACTTTACTATC | 28 | 330 |
| 1354043 | N/A | N/A | 212832 | 212851 | TGCAACTGTTCATCTCACCT | 59 | 331 |
| 1354046 | N/A | N/A | 95359 | 95378 | GCTACAATTATCCACATGGC | 32 | 332 |
| 1354049 | N/A | N/A | 89149 | 89168 | GTGTATTTTCCCATACTGTA | 16 | 333 |
| 1354050 | N/A | N/A | 172859 | 172878 | GCAGTCAATCAACTCCAACT | 22 | 334 |
| 1354053 | N/A | N/A | 73586 | 73605 | TTGCCAATTTTCAGCCTACA | 38 | 335 |
| 1354060 | N/A | N/A | 131535 | 131554 | GCACCATCTATAATACCATC | 17 | 336 |
| 1354063 | N/A | N/A | 181233 | 181252 | GTAGTTTAATTCACCATCAC | 15 | 337 |

TABLE 4-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354064 | N/A | N/A | 222419 | 222438 | TTGTACTGAACTGACTCCAA | 41 | 338 |
| 1354071 | N/A | N/A | 63463 | 63482 | CACATCATGGTTCATACTCC | 24 | 339 |
| 1354072 | N/A | N/A | 154738 | 154757 | AGGTCTCTATATTTTGGTCC | 19 | 340 |
| 1354081 | N/A | N/A | 136250 | 136269 | GCTTCATTACCACTTCTGAT | 19 | 341 |

TABLE 5

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1353641 | N/A | N/A | 179401 | 179420 | AAGAGCTTTTTCTATCTCCT | 60 | 342 |
| 1353655 | N/A | N/A | 101644 | 101663 | TCCGGATTATTTCACATTCT | 18 | 343 |
| 1353657 | N/A | N/A | 86554 | 86573 | GTGCTCATTTCACATCAGAC | 26 | 344 |
| 1353660 | 2590 | 2609 | 292574 | 292593 | AGCTAAATTCTTTACAGTAC | 31 | 345 |
| 1353661 | N/A | N/A | 7782 | 7801 | GTCTGCTTTTCTTCTTATAC | 23 | 346 |
| 1353663 | 1780 | 1799 | 262097 | 262116 | CGTAACTGATCCTTGGTTCA | 48 | 347 |
| 1353665 | N/A | N/A | 276318 | 276337 | AACCCAGAACCTGTATTACA | 88 | 348 |
| 1353679 | N/A | N/A | 276079 | 276098 | GCTGCCTTTAAATACATGCT | 40 | 349 |
| 1353687 | N/A | N/A | 167609 | 167628 | ATGCCATTTACTACACTGAA | 39 | 350 |
| 1353690 | N/A | N/A | 153294 | 153313 | AGCATCTTTTACTATCTGCC | 28 | 351 |
| 1353697 | N/A | N/A | 118930 | 118949 | CTGTATCTTGTCATTCCTTA | 27 | 352 |
| 1353709 | N/A | N/A | 183237 | 183256 | TGGTTATTTACCTCTACGGC | 113 | 353 |
| 1353710 | N/A | N/A | 161596 | 161615 | GCATCATTTTTATATGAGAT | 16 | 354 |
| 1353713 | N/A | N/A | 19228 | 19247 | TCCAGATATTACTTTCTTCA | 24 | 355 |
| 1353723 | N/A | N/A | 51896 | 51915 | GAAGCATATTCCTCTATCCT | 19 | 356 |
| 1353729 | N/A | N/A | 46766 | 46785 | GTGGTAACTATTTCTGGGCA | 50 | 357 |
| 1353730 | N/A | N/A | 219395 | 219414 | TACCAACTTCATCCTGAATC | 71 | 358 |
| 1353738 | N/A | N/A | 194605 | 194624 | TTGGATTTATCAATCTTCAA | 33 | 359 |
| 1353747 | 698 | 717 | 151960 | 151979 | ACTTCTACTACTTTGTCTTC | 39† | 360 |
| 1353753 | N/A | N/A | 12614 | 12633 | GCATTCACAACACACATCCT | 21 | 361 |
| 1353755 | N/A | N/A | 105705 | 105724 | TGCAACTCTTCTTTCAAGGT | 39 | 362 |
| 1353757 | N/A | N/A | 198583 | 198602 | CACTTTCTTGCACTCTCCAA | 79 | 363 |
| 1353758 | N/A | N/A | 33695 | 33714 | ACCACAACTTGACCCAGGCC | 57 | 364 |
| 1353762 | N/A | N/A | 173247 | 173266 | GTGACTTATACTCAATGACA | 23 | 365 |
| 1353765 | N/A | N/A | 33846 | 33865 | TCACAGTACTCACTTACATA | 52 | 366 |

TABLE 5-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1353776 | N/A | N/A | 285840 | 285859 | GTACTCATTTTGTTCTTAC | 68 | 367 |
| 1353791 | N/A | N/A | 281406 | 281425 | AGTCACTCATAACTCATGCT | 54 | 368 |
| 1353792 | N/A | N/A | 223647 | 223666 | TGCAACTTTTCAAGCAAGGA | 20 | 369 |
| 1353805 | N/A | N/A | 54772 | 54791 | GCTTTTTTAATTCTTCAATC | 55 | 370 |
| 1353809 | 2114 | 2133 | 282148 | 282167 | CCTTTGTTTGAACCCACATC | 70 | 371 |
| 1353810 | N/A | N/A | 33638 | 33657 | TCAACACTAACCCAACTTCT | 72 | 372 |
| 1353813 | N/A | N/A | 122991 | 123010 | CCACCTTACCTCCCATCTGC | 102† | 373 |
| 1353814 | N/A | N/A | 219406 | 219425 | AACAGCTTACTTACCAACTT | 95 | 374 |
| 1353815 | N/A | N/A | 26969 | 26988 | GCACAACTTTATTTCTAGAC | 12 | 375 |
| 1353816 | N/A | N/A | 206339 | 206358 | GTCTAATTTCTCTTCAACAG | 55 | 376 |
| 1353821 | N/A | N/A | 191271 | 191290 | GTCCATTTTGCAATTATAGC | 35 | 377 |
| 1353828 | N/A | N/A | 263976 | 263995 | TAGTCTATATATTTTCTGCA | 24 | 378 |
| 1353829 | 447 | 466 | 120710 | 120729 | GCAAACATCCATCCTCTCCT | 35 | 379 |
| 1353836 | N/A | N/A | 105740 | 105759 | CCAACCTATTACCATCTGGC | 50 | 380 |
| 1353845 | N/A | N/A | 40654 | 40673 | ACACACTTGCCAATATCCTC | 50 | 381 |
| 1353848 | N/A | N/A | 4684 | 4703 | TCTTAATCTTCACTCAATTC | 110 | 382 |
| 1353856 | N/A | N/A | 271256 | 271275 | CAGAACATTCTTGTTAGCAC | 35 | 383 |
| 1353861 | N/A | N/A | 22919 | 22938 | CAGCAGCATTTCATCACAAT | 27 | 384 |
| 1353862 | N/A | N/A | 131601 | 131620 | GTGCATAATTTATTACATGA | 34 | 385 |
| 1353870 | 606 | 625 | 122911 | 122930 | ATCCACATTGTCACTTTCTT | 34 | 386 |
| 1353876 | N/A | N/A | 230838 | 230857 | AAGCATCATATATATACTTC | 65 | 387 |
| 1353877 | 1512 | 1531 | 218265 | 218284 | GCGGACATACTTCTTTAGCA | 35 | 388 |
| 1353881 | N/A | N/A | 59977 | 59996 | CAGTACTTTATTCTGTTCAC | 79 | 389 |
| 1353894 | N/A | N/A | 234610 | 234629 | GCATTAGTTTCTTTAATGGT | 35 | 390 |
| 1353904 | N/A | N/A | 113619 | 113638 | CAACTCTTTCAACTCTTGCA | 56 | 391 |
| 1353915 | N/A | N/A | 282272 | 282291 | AAGTTTACCTACCTCCACCA | 97 | 392 |
| 1353919 | N/A | N/A | 128792 | 128811 | TGGCTATATTCTCTCTTCAA | 29 | 393 |
| 1353921 | N/A | N/A | 105862 | 105881 | CATACCATACTCAGAAAGCC | 62 | 394 |
| 1353929 | N/A | N/A | 95932 | 95951 | TTTCTTATATCCATGATGCT | 62 | 395 |
| 1353941 | N/A | N/A | 120617 | 120636 | CCACTTCCCGTCATTCCATC | 81 | 396 |
| 1353944 | N/A | N/A | 246486 | 246505 | CCAGTTTTATCTTGACCTC | 40 | 397 |
| 1353965 | N/A | N/A | 226558 | 226577 | GGAGACATTTCAACATGGCA | 25 | 398 |
| 1353970 | 2072 | 2091 | 276402 | 276421 | TGATGATGAACTTCATATCC | 85 | 399 |
| 1353971 | N/A | N/A | 84227 | 84246 | CTCAAAAATACTGCTCCTAT | 74 | 400 |
| 1353987 | N/A | N/A | 30591 | 30610 | TGGTTAGGTCACTTCTTTTA | 40 | 401 |
| 1353988 | 3226 | 3245 | 293210 | 293229 | GTAGTCATCCTTCAAAGAAA | 78 | 402 |

TABLE 5-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1353997 | N/A | N/A | 105874 | 105893 | ATGCTGTTTTCACATACCAT | 52 | 403 |
| 1354000 | N/A | N/A | 10349 | 10368 | GTGAACCCACTTCTTGTCTT | 33 | 404 |
| 1354002 | 3347 | 3366 | 293331 | 293350 | CCTTATATTGCCACTTCCAT | 71 | 405 |
| 1354009 | N/A | N/A | 136343 | 136362 | CACTGCACTTAGTTCCACCA | 64 | 406 |
| 1354010 | N/A | N/A | 176271 | 176290 | CGATGCATTTTTTCACAAAA | 32 | 407 |
| 1354024 | N/A | N/A | 214164 | 214183 | GTGCTAAATTCATCCTTATC | 47 | 408 |
| 1354033 | N/A | N/A | 90338 | 90357 | CCTTGCTATTCATTTTTCAA | 27 | 409 |
| 1354040 | N/A | N/A | 33767 | 33786 | GCTCCAATCATTGTCAATTA | 52 | 410 |
| 1354044 | 2912 | 2931 | 292896 | 292915 | ATCCTCTTAATTCCTATATC | 36 | 411 |
| 1354054 | 555 | 574 | 122860 | 122879 | TCGGAACTTGTCAATTCCGC | 92 | 412 |
| 1354058 | N/A | N/A | 228472 | 228491 | ACGGACTCACACTTGCTGAT | 43 | 413 |
| 1354062 | N/A | N/A | 164093 | 164112 | GAATGTACTTCCTTATACCA | 44 | 414 |
| 1354065 | N/A | N/A | 74023 | 74042 | ATCCACACTTTCATACTCAG | 103 | 415 |
| 1354077 | N/A | N/A | 65593 | 65612 | TAGCACACATCAGTTTCCAC | 37 | 416 |
| 1354079 | N/A | N/A | 92844 | 92863 | TACACCATATTACTTATGCA | 37 | 417 |
| 1354085 | N/A | N/A | 84370 | 84389 | ATGAGAATCATCTATGCGAT | 48 | 418 |
| 1354100 | N/A | N/A | 158755 | 158774 | TGCTAATGTTTCAAATGCAA | 39 | 419 |

TABLE 6

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1353638 | N/A | N/A | 19930 | 19949 | TCCACATTTGCTTACATTCT | 29 | 420 |
| 1353654 | N/A | N/A | 228475 | 228494 | ATAACGGACTCACACTTGCT | 46 | 421 |
| 1353664 | N/A | N/A | 27002 | 27021 | GACACTTTTATCTTGCACTA | 18 | 422 |
| 1353671 | N/A | N/A | 95933 | 95952 | GTTTCTTATATCCATGATGC | 12 | 423 |
| 1353673 | N/A | N/A | 87912 | 87931 | GTGCCAATTTCAACAGTGGA | 18 | 424 |
| 1353695 | 1860 | 1879 | 262177 | 262196 | CAGGCTGAACTCTCCATTCA | 75 | 425 |
| 1353701 | N/A | N/A | 226834 | 226853 | AGGTCATTATCAATGACTTC | 50 | 426 |
| 1353704 | N/A | N/A | 120232 | 120251 | TTGGACATTTTAATCTGCTT | 43 | 427 |
| 1353707 | 2000 | 2019 | 276330 | 276349 | TTGATATTGTCAACCCAGA | 41 | 428 |
| 1353711 | N/A | N/A | 33818 | 33837 | ACAGAACCAACAAGTCCTCT | 47 | 429 |
| 1353712 | N/A | N/A | 194644 | 194663 | AGCAATTTCCACTGCAGGC | 55 | 430 |
| 1353714 | N/A | N/A | 33639 | 33658 | GTCAACACTAACCCAACTTC | 45 | 431 |
| 1353715 | N/A | N/A | 219397 | 219416 | CTTACCAACTTCATCCTGAA | 81 | 432 |

TABLE 6-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1353725 | N/A | N/A | 8660 | 8679 | ACTCACACACTGTTTCAAGC | 18 | 433 |
| 1353728 | N/A | N/A | 198591 | 198610 | GCTTACTTCACTTTCTTGCA | 33 | 434 |
| 1353734 | N/A | N/A | 167693 | 167712 | TCTGATATTCACTTATCTGA | 26 | 435 |
| 1353743 | N/A | N/A | 282273 | 282292 | CAAGTTTACCTACCTCCACC | 88 | 436 |
| 1353744 | 2153 | 2172 | 282187 | 282206 | GCTATGACAACACCGCCCAC | 48 | 437 |
| 1353749 | N/A | N/A | 92931 | 92950 | GTGAATCTTCTTTTACCACA | 13 | 438 |
| 1353751 | 448 | 467 | 120711 | 120730 | CGCAAACATCCATCCTCTCC | 40 | 439 |
| 1353756 | N/A | N/A | 55920 | 55939 | CCAAGCTTTTTTACTACTCA | 71 | 440 |
| 1353759 | 2591 | 2610 | 292575 | 292594 | CAGCTAAATTCTTTACAGTA | 43 | 441 |
| 1353761 | N/A | N/A | 180027 | 180046 | GTTGTTTGTACCACATGTCA | 49 | 442 |
| 1353764 | N/A | N/A | 286488 | 286507 | AAGTCAATATTTCCTGCTTA | 42 | 443 |
| 1353780 | N/A | N/A | 259747 | 259766 | GCTTGCTTTTCCACACCACC | 53 | 444 |
| 1353783 | N/A | N/A | 162208 | 162227 | GCAAGACTTTTCTTTGCTCC | 19 | 445 |
| 1353799 | N/A | N/A | 49548 | 49567 | TCCTAATTCTTTGATAACAC | 47 | 446 |
| 1353839 | N/A | N/A | 32280 | 32299 | GTATTATTTCTTTTACGCCT | 18 | 447 |
| 1353851 | 576 | 595 | 122881 | 122900 | GCAACACACAAACTCTACCC | 34 | 448 |
| 1353853 | N/A | N/A | 105708 | 105727 | ATCTGCAACTCTTCTTTCAA | 108 | 449 |
| 1353860 | 3228 | 3247 | 293212 | 293231 | CTGTAGTCATCCTTCAAAGA | 66 | 450 |
| 1353868 | N/A | N/A | 219407 | 219426 | GAACAGCTTACTTACCAACT | 80 | 451 |
| 1353884 | N/A | N/A | 158795 | 158814 | GTTTACCTTTAACATTCCTC | 18 | 452 |
| 1353892 | 1175 | 1194 | 191574 | 191593 | TCATTCTCATCCCCAGGTGT | 40 | 453 |
| 1353895 | N/A | N/A | 139767 | 139786 | GTCTAATTATACCATTCCTC | 51 | 454 |
| 1353911 | N/A | N/A | 41356 | 41375 | CACAACATATATGTATCTCC | 18 | 455 |
| 1353912 | N/A | N/A | 120620 | 120639 | AAACCACTTCCCGTCATTCC | 129 | 456 |
| 1353918 | 614 | 633 | 122919 | 122938 | TCAGCAGAATCCACATTGTC | 51 | 457 |
| 1353924 | N/A | N/A | 75269 | 75288 | GCCTACTTTTCTACTTAGTC | 44 | 458 |
| 1353925 | N/A | N/A | 234725 | 234744 | GCCAGCTTTTCCTTTCACAT | 39 | 459 |
| 1353927 | N/A | N/A | 271490 | 271509 | CACTTCATATCTGAGCATTC | 43 | 460 |
| 1353930 | N/A | N/A | 281694 | 281713 | GTCAGCATTTTCCTAGTCAT | 75 | 461 |
| 1353931 | N/A | N/A | 101718 | 101737 | GCCATATTGTCATTTTACAC | 16 | 462 |
| 1353939 | N/A | N/A | 219072 | 219091 | GTTCTCCTATTTCTGTTCTC | 79 | 463 |
| 1353953 | N/A | N/A | 84435 | 84454 | GCAGCTTCACATTAGATTCT | 24 | 464 |
| 1353956 | N/A | N/A | 184659 | 184678 | ACTCCATTTCATATTCATAC | 21 | 465 |
| 1353960 | N/A | N/A | 176674 | 176693 | CAAGCAGCATCCTCCTCCCC | 77 | 466 |
| 1353962 | N/A | N/A | 10485 | 10504 | GTCCTATTTATTCCTCATCC | 40 | 467 |
| 1353964 | N/A | N/A | 132421 | 132440 | ACAGTATTTCTCATTCAGCA | 26 | 468 |

TABLE 6-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1353966 | N/A | N/A | 53082 | 53101 | ACATTCATGCTACTGCAATC | 112 | 469 |
| 1353973 | N/A | N/A | 24844 | 24863 | AATCAATTGCATTCCAAGGC | 20 | 470 |
| 1353975 | N/A | N/A | 164096 | 164115 | CCAGAATGTACTTCCTTATA | 52 | 471 |
| 1353976 | N/A | N/A | 35655 | 35674 | AGATCATATACTATACACAA | 16 | 472 |
| 1353994 | N/A | N/A | 106120 | 106139 | TAGGTATTCTCACTGGTTGC | 44 | 473 |
| 1353998 | N/A | N/A | 276226 | 276245 | CAAAACTTCTTTCTAGGCCT | 48 | 474 |
| 1353999 | N/A | N/A | 4687 | 4706 | CCGTCTTAATCTTCACTCAA | 32 | 475 |
| 1354012 | N/A | N/A | 153322 | 153341 | GTACATATTCATTCAATCTA | 24 | 476 |
| 1354014 | N/A | N/A | 230840 | 230859 | GCAAGCATCATATATATACT | 40 | 477 |
| 1354017 | N/A | N/A | 122999 | 123018 | CACAAAGGCCACCTTACCTC | 67† | 478 |
| 1354027 | N/A | N/A | 224097 | 224116 | CATCACTTTACTATCTGGGC | 27 | 479 |
| 1354028 | N/A | N/A | 66492 | 66511 | GCACTCTTATCTTTCCCCTC | 43 | 480 |
| 1354031 | N/A | N/A | 90387 | 90406 | GCACACATTTGCAATTCTTA | 9 | 481 |
| 1354035 | 2914 | 2933 | 292898 | 292917 | GTATCCTCTTAATTCCTATA | 26 | 482 |
| 1354039 | N/A | N/A | 214339 | 214358 | GTTCCATTATTCCTTAGCTA | 26 | 483 |
| 1354047 | N/A | N/A | 115871 | 115890 | CTGTACTGCCATCCTGAGCA | 64 | 484 |
| 1354059 | 3350 | 3369 | 293334 | 293353 | TCCCCTTATATTGCCACTTC | 52 | 485 |
| 1354066 | N/A | N/A | 264370 | 264389 | CGCAGATTTTCTCCTAAGGC | 34 | 486 |
| 1354067 | N/A | N/A | 173443 | 173462 | GTCAACTTTCATGTAAGGAA | 14 | 487 |
| 1354068 | N/A | N/A | 12940 | 12959 | GCTGTTCGAATCTTCAATCT | 25 | 488 |
| 1354073 | N/A | N/A | 105865 | 105884 | TCACATACCATACTCAGAAA | 57 | 489 |
| 1354074 | N/A | N/A | 33700 | 33719 | CAGTGACCACAACTTGACCC | 45 | 490 |
| 1354082 | N/A | N/A | 278101 | 278120 | TTGTAATATTCATTGCACTA | 48 | 491 |
| 1354083 | N/A | N/A | 105743 | 105762 | TTTCCAACCTATTACCATCT | 93 | 492 |
| 1354084 | N/A | N/A | 128965 | 128984 | GCAACACATTTATTTGATAC | 21 | 493 |
| 1354088 | N/A | N/A | 207518 | 207537 | GCAGTCTTTCAACTTTTAAT | 30 | 494 |
| 1354090 | 879 | 898 | 152141 | 152160 | TCGAACCACCTCTTCCACAG | 89 | 495 |
| 1354096 | N/A | N/A | 84229 | 84248 | AACTCAAAAATACTGCTCCT | 58 | 496 |
| 1354104 | 177 | 196 | 61940 | 61959 | TGAATCCCACTTCCCATTCT | 43 | 497 |

TABLE 7

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 28 | 178 |
| 1397536 | N/A | N/A | 20330 | 20349 | CTCTAAGCATTGTCCCAGAC | 97 | 498 |
| 1397546 | N/A | N/A | 51886 | 51905 | CCTCTATCCTTTGTCAGCCC | 88 | 499 |
| 1397549 | N/A | N/A | 180977 | 180996 | GCTCCTGTCTTTACAACGAC | 43 | 500 |
| 1397553 | N/A | N/A | 218532 | 218551 | GCCAAACCACATATTGCTCT | 54 | 501 |
| 1397597 | N/A | N/A | 16201 | 16220 | TGCATAGATCTTCCCATTCT | 50 | 502 |
| 1397629 | N/A | N/A | 36133 | 36152 | TTGTTCCTTCATTTAGTGGA | 63 | 503 |
| 1397707 | N/A | N/A | 177940 | 177959 | TGGCATATATCATCCCTAAC | 31 | 504 |
| 1397760 | N/A | N/A | 222733 | 222752 | CAGCATGACTCCATTCTTCC | 43 | 505 |
| 1397819 | N/A | N/A | 19452 | 19471 | AGTTTTGTCCAAATCAGGCC | 34 | 506 |
| 1397865 | N/A | N/A | 83559 | 83578 | GCCTGCTCTACCTCTGACCA | 85 | 507 |
| 1397871 | N/A | N/A | 12325 | 12344 | TAGTCTGCATATTTTCACAT | 129 | 508 |
| 1397915 | N/A | N/A | 277176 | 277195 | CTCCATGATCTTACTCTTGC | 70 | 509 |
| 1397972 | N/A | N/A | 9591 | 9610 | CTGGCATTTGAAATCTTCCA | 23 | 510 |
| 1398022 | N/A | N/A | 41110 | 41129 | AGTGCATCATATTCTACACT | 45 | 511 |
| 1398029 | N/A | N/A | 247486 | 247505 | TCATGGCCTTTTCATACCCA | 63 | 512 |
| 1398111 | N/A | N/A | 66405 | 66424 | CCACTGCTCATCTCCCTCAT | 76 | 513 |
| 1398159 | N/A | N/A | 186569 | 186588 | TAGCAGCAATACCAACATCA | 49 | 514 |
| 1398180 | N/A | N/A | 283786 | 283805 | TTCCTCACACTGCTCATCCA | 107 | 515 |
| 1398205 | N/A | N/A | 22544 | 22563 | AGCCTTTCCTTATTTTTGCT | 42 | 516 |
| 1398208 | N/A | N/A | 130875 | 130894 | TAGCCATCCCTCTTCTGCCC | 78 | 517 |
| 1398237 | N/A | N/A | 59235 | 59254 | TTGTCATCCTCCCTGCTTCT | 143 | 518 |
| 1398238 | N/A | N/A | 154736 | 154755 | GTCTCTATATTTTGGTCCCA | 20 | 519 |
| 1398239 | N/A | N/A | 85262 | 85281 | ACTGCACTTTTTGATGAACC | 57 | 520 |
| 1398245 | N/A | N/A | 10438 | 10457 | CTGGAACCATCTTAATCACT | 62 | 521 |
| 1398271 | N/A | N/A | 153179 | 153198 | TTGGTCATTTAATATCAACT | 27 | 522 |
| 1398328 | N/A | N/A | 98898 | 98917 | TGCTCCACATCTTCTGTCTT | 66 | 523 |
| 1398340 | N/A | N/A | 262025 | 262044 | GCTCATCTAAACCAAACAAA | 92 | 524 |
| 1398388 | N/A | N/A | 28247 | 28266 | CTGCTACTGACATAATACAC | 87 | 525 |
| 1398391 | N/A | N/A | 104334 | 104353 | AAGAGCTTATTAACTGCCTC | 56 | 526 |
| 1398402 | N/A | N/A | 8054 | 8073 | TGTGAATTTATTCCTAGAGC | 42 | 527 |
| 1398418 | N/A | N/A | 50161 | 50180 | GAGGCAATCTGATATTGACA | 62 | 528 |
| 1398437 | N/A | N/A | 32628 | 32647 | GGCACAGTCTTATTATGACA | 47 | 529 |
| 1398439 | N/A | N/A | 53337 | 53356 | TGAGCTTCTTTTCTCCTACA | 51 | 530 |
| 1398448 | N/A | N/A | 235762 | 235781 | GCATCTGAACTTCTTGAGGT | 34 | 531 |
| 1398477 | N/A | N/A | 211022 | 211041 | GTGCACCCTCACACCGACCT | 54 | 532 |

TABLE 7-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398503 | N/A | N/A | 96479 | 96498 | AATTTGCCTCATTTTCTATG | 64 | 533 |
| 1398514 | N/A | N/A | 274850 | 274869 | GTGAAGCTATCTTCTCTCCT | 41 | 534 |
| 1398538 | N/A | N/A | 88573 | 88592 | TAGGTCCCACACATGCATCT | 71 | 535 |
| 1398596 | N/A | N/A | 159977 | 159996 | AAGCATGCTACAACCCGGGC | 48 | 536 |
| 1398600 | N/A | N/A | 290099 | 290118 | GTTCCATCCATTATGTGCCC | 86 | 537 |
| 1398677 | N/A | N/A | 172780 | 172799 | TGCCACCCTCCCCAAGATCA | 93 | 538 |
| 1398693 | N/A | N/A | 196724 | 196743 | CAGCTGCCTTTTCAAGTGTA | 79 | 539 |
| 1398775 | N/A | N/A | 13727 | 13746 | CCACAATTCAACTAGCAGCA | 62 | 540 |
| 1398791 | N/A | N/A | 271277 | 271296 | GTACTCCATCTCCTCCCATC | 69 | 541 |
| 1398797 | N/A | N/A | 25026 | 25045 | CTCCAACATCCACACTCAGA | 66 | 542 |
| 1398808 | N/A | N/A | 92208 | 92227 | ATATCAGTTTTTCTCTAGGT | 43 | 543 |
| 1398826 | N/A | N/A | 4666 | 4685 | TCGATCCTTTTATCTGCACC | 33 | 544 |
| 1398871 | N/A | N/A | 104721 | 104740 | CTCCACTCAAACTCTCCATA | 112 | 545 |
| 1398877 | N/A | N/A | 207866 | 207885 | CTCTTGTTACATACTTCCCA | 67 | 546 |
| 1398913 | N/A | N/A | 158957 | 158976 | CAGATATTTCAATATACAGT | 25 | 547 |
| 1398915 | N/A | N/A | 122623 | 122642 | GCATGGGTTACACTTTGGTA | 57 | 548 |
| 1398931 | N/A | N/A | 31689 | 31708 | CCACCACACAGCCCTCACTC | 96 | 549 |
| 1398942 | N/A | N/A | 27081 | 27100 | CCACCTTCCTTCTATGTACA | 57 | 550 |
| 1398963 | N/A | N/A | 43440 | 43459 | CAGCACTGAGAATCAAGTTC | 48 | 551 |
| 1398996 | N/A | N/A | 38482 | 38501 | GACCTCTTTTATTTTAGTCA | 70 | 552 |
| 1399019 | N/A | N/A | 101646 | 101665 | TTTCCGGATTATTTCACATT | 67 | 553 |
| 1399030 | N/A | N/A | 7225 | 7244 | GCTACTGAAGCTCTCTGGTC | 44 | 554 |
| 1399037 | N/A | N/A | 90276 | 90295 | GCTGGGTTTCTTTTTCTCAC | 36 | 555 |
| 1399048 | 670 | 689 | 122975 | 122994 | CTGCATAGTCTGTGTCTGCT | 26† | 556 |
| 1399049 | N/A | N/A | 33961 | 33980 | TGCAAACTTCATCCCTACTT | 46 | 557 |
| 1399075 | N/A | N/A | 136253 | 136272 | AGTGCTTCATTACCACTTCT | 32 | 558 |
| 1399084 | N/A | N/A | 95341 | 95360 | GCATAAACCATAGAGCTCTC | 45 | 559 |
| 1399130 | N/A | N/A | 46665 | 46684 | AAGACTTTCAAATTCTAGCC | 51 | 560 |
| 1399138 | N/A | N/A | 15399 | 15418 | AACCATGAATATCAATGCCT | 30 | 561 |
| 1399167 | N/A | N/A | 105775 | 105794 | TAGACTGTCACTCTCACGCC | 96 | 562 |
| 1399180 | N/A | N/A | 24049 | 24068 | GTATTGTTCTCTCCAGGTTT | 45 | 563 |
| 1399241 | N/A | N/A | 48042 | 48061 | GCTAATGCATTCCTTACCCC | 48 | 564 |
| 1399242 | N/A | N/A | 74672 | 74691 | AGCTTTTCCATACCAGTCCC | 74 | 565 |
| 1399278 | N/A | N/A | 30241 | 30260 | ACTCTTGTTTCCATGAGTTT | 77 | 566 |
| 1399288 | N/A | N/A | 191322 | 191341 | GATGTCTTTCACCACTCCCA | 53 | 567 |
| 1399306 | N/A | N/A | 103107 | 103126 | ACAAGGCTACTCTTCAACTT | 109 | 568 |

TABLE 7-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1399336 | N/A | N/A | 87088 | 87107 | GCTGACTCTCCCATTTATTT | 31 | 569 |
| 1399357 | N/A | N/A | 228777 | 228796 | ATGCTAAATCAGTTCTCTTG | 37 | 570 |
| 1399366 | N/A | N/A | 286108 | 286127 | CGCCCCATGCCACATTTCTC | 76 | 571 |
| 1399387 | N/A | N/A | 266250 | 266269 | GCCTTGTACAAACTCTCTAC | 75 | 572 |
| 1399413 | N/A | N/A | 115996 | 116015 | CCACATGTCAAACCGTGGCT | 91 | 573 |
| 1399414 | N/A | N/A | 167484 | 167503 | ACGCTACATTCCATTTTCTA | 76 | 574 |

TABLE 8

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 9 | 178 |
| 1397547 | N/A | N/A | 41113 | 41132 | CCTAGTGCATCATATTCTAC | 122 | 575 |
| 1397552 | N/A | N/A | 167698 | 167717 | GCTTTTCTGATATTCACTTA | 31 | 576 |
| 1397573 | N/A | N/A | 158959 | 158978 | TGCAGATATTTCAATATACA | 16 | 577 |
| 1397586 | N/A | N/A | 186616 | 186635 | GTTCAATATCCTTAGCTCTA | 48 | 578 |
| 1397618 | N/A | N/A | 228778 | 228797 | CATGCTAAATCAGTTCTCTT | 39 | 579 |
| 1397632 | N/A | N/A | 160222 | 160241 | ATGGCTCTATTCCCTAGTCT | 26 | 580 |
| 1397660 | N/A | N/A | 32629 | 32648 | GGGCACAGTCTTATTATGAC | 40 | 581 |
| 1397668 | N/A | N/A | 274919 | 274938 | GCTTCCACTTGATAACCTAT | 47 | 582 |
| 1397832 | N/A | N/A | 92225 | 92244 | GCTCATTACCCATCCTTATA | 31 | 583 |
| 1397850 | N/A | N/A | 277181 | 277200 | GCTCACTCCATGATCTTACT | 62 | 584 |
| 1397859 | N/A | N/A | 191323 | 191342 | GGATGTCTTTCACCACTCCC | 49 | 585 |
| 1397869 | N/A | N/A | 36146 | 36165 | GCAGGTCCTATTTTTGTTCC | 53 | 586 |
| 1397872 | N/A | N/A | 248516 | 248535 | CCTCAGGTCCCACCCAGATC | 97 | 587 |
| 1397879 | N/A | N/A | 290135 | 290154 | GTAGATATACAGCTCCCTCA | 74 | 588 |
| 1397889 | N/A | N/A | 222749 | 222768 | TAGCATTCCTTCTTCTCAGC | 29 | 589 |
| 1397905 | N/A | N/A | 154737 | 154756 | GGTCTCTATATTTTGGTCCC | 24 | 590 |
| 1397910 | N/A | N/A | 262028 | 262047 | GCAGCTCATCTAAACCAAAC | 93 | 591 |
| 1397937 | N/A | N/A | 104737 | 104756 | TGGGACTATAACTCTACTCC | 35 | 592 |
| 1398012 | N/A | N/A | 181001 | 181020 | AGGCATTCAGACTTCTGTCT | 19 | 593 |
| 1398018 | N/A | N/A | 283789 | 283808 | TCCTTCCTCACACTGCTCAT | 84 | 594 |
| 1398058 | 671 | 690 | 122976 | 122995 | TCTGCATAGTCTGTGTCTGC | 14† | 595 |
| 1398065 | N/A | N/A | 22545 | 22564 | CAGCCTTTCCTTATTTTTGC | 20 | 596 |
| 1398066 | N/A | N/A | 51895 | 51914 | AAGCATATTCCTCTATCCTT | 84 | 597 |

TABLE 8-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398068 | N/A | N/A | 20335 | 20354 | GAATCCTCTAAGCATTGTCC | 32 | 598 |
| 1398110 | N/A | N/A | 104346 | 104365 | ACTGTGCTCTTCAAGAGCTT | 112 | 599 |
| 1398112 | N/A | N/A | 76738 | 76757 | GCTACCTCCTATTCTGCTGA | 76 | 600 |
| 1398121 | N/A | N/A | 95363 | 95382 | TCTGGCTACAATTATCCACA | 27 | 601 |
| 1398131 | N/A | N/A | 106105 | 106124 | GTTGCTTTCTCCTAACACTT | 24 | 602 |
| 1398133 | N/A | N/A | 53483 | 53502 | TGGCTTATGATCTATACACT | 23 | 603 |
| 1398143 | N/A | N/A | 16217 | 16236 | GATCAATGTTCCTTTTTGCA | 28 | 604 |
| 1398192 | N/A | N/A | 43475 | 43494 | GCAACTCACAACTAATGTCT | 43 | 605 |
| 1398215 | N/A | N/A | 211438 | 211457 | TGGCCTTCCCAATTTTCACC | 44 | 606 |
| 1398222 | N/A | N/A | 130876 | 130895 | GTAGCCATCCCTCTTCTGCC | 68 | 607 |
| 1398235 | N/A | N/A | 87089 | 87108 | TGCTGACTCTCCCATTTATT | 52 | 608 |
| 1398289 | N/A | N/A | 28249 | 28268 | ATCTGCTACTGACATAATAC | 87 | 609 |
| 1398304 | N/A | N/A | 98899 | 98918 | CTGCTCCACATCTTCTGTCT | 78 | 610 |
| 1398316 | N/A | N/A | 25030 | 25049 | ATGACTCCAACATCCACACT | 63 | 611 |
| 1398344 | N/A | N/A | 13728 | 13747 | TCCACAATTCAACTAGCAGC | 64 | 612 |
| 1398382 | N/A | N/A | 19453 | 19472 | AAGTTTTGTCCAAATCAGGC | 30 | 613 |
| 1398457 | N/A | N/A | 30250 | 30269 | CACCCTTCTACTCTTGTTTC | 66 | 614 |
| 1398494 | N/A | N/A | 12458 | 12477 | TGGTTGTACCCCTAAGAATC | 23 | 615 |
| 1398501 | N/A | N/A | 88705 | 88724 | TGGTCATTCCTTATGAGACC | 91 | 616 |
| 1398506 | N/A | N/A | 33962 | 33981 | TTGCAAACTTCATCCCTACT | 56 | 617 |
| 1398524 | N/A | N/A | 207867 | 207886 | TCTCTTGTTACATACTTCCC | 78 | 618 |
| 1398528 | N/A | N/A | 90300 | 90319 | TTGGGACAATATCATGCCAA | 27 | 619 |
| 1398559 | N/A | N/A | 66406 | 66425 | GCCACTGCTCATCTCCCTCA | 36 | 620 |
| 1398560 | N/A | N/A | 15499 | 15518 | GCACATTTACATGCTCCCTT | 52 | 621 |
| 1398569 | N/A | N/A | 96508 | 96527 | TCTACAGTTAATATTTGCCC | 19 | 622 |
| 1398578 | N/A | N/A | 10442 | 10461 | GCTTCTGGAACCATCTTAAT | 47 | 623 |
| 1398603 | N/A | N/A | 38617 | 38636 | AGCCAAGTTCATATCAAACT | 24 | 624 |
| 1398617 | N/A | N/A | 196847 | 196866 | GCTCTCAACTTTGATGTTCA | 60 | 625 |
| 1398653 | N/A | N/A | 9622 | 9641 | AAGCTTCCATATTAGGACCA | 20 | 626 |
| 1398673 | N/A | N/A | 116378 | 116397 | TCTGCAGGCCTCAATCTGCT | 79 | 627 |
| 1398702 | N/A | N/A | 177973 | 177992 | TGTGCCTCTTCTTCCAGCAA | 40 | 628 |
| 1398787 | N/A | N/A | 218615 | 218634 | TCATTGGTTTTAATCAGTTC | 40 | 629 |
| 1398879 | N/A | N/A | 286122 | 286141 | CACAGCGATCAAACCGCCCC | 82 | 630 |
| 1398896 | N/A | N/A | 173494 | 173513 | GCACATCACAACAATTCTCC | 28 | 631 |
| 1398916 | N/A | N/A | 8087 | 8106 | TGATGCACATATCCAGGCTT | 19 | 632 |
| 1398953 | N/A | N/A | 50175 | 50194 | GTGACACAACATCAGAGGCA | 51 | 633 |

TABLE 8-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398982 | N/A | N/A | 101647 | 101666 | GTTTCCGGATTATTTCACAT | 49 | 634 |
| 1399000 | N/A | N/A | 59436 | 59455 | GCATCACAATTCTTCATTGC | 75 | 635 |
| 1399028 | N/A | N/A | 103109 | 103128 | GAACAAGGCTACTCTTCAAC | 57 | 636 |
| 1399045 | N/A | N/A | 24060 | 24079 | GCCTTTACACTGTATTGTTC | 21 | 637 |
| 1399050 | N/A | N/A | 27082 | 27101 | CCCACCTTCCTTCTATGTAC | 36 | 638 |
| 1399057 | N/A | N/A | 122706 | 122725 | GCAGACCCAATATATTAGGA | 63 | 639 |
| 1399058 | N/A | N/A | 271278 | 271297 | AGTACTCCATCTCCTCCCAT | 78 | 640 |
| 1399139 | N/A | N/A | 31690 | 31709 | ACCACCACACAGCCCTCACT | 75 | 641 |
| 1399181 | N/A | N/A | 153192 | 153211 | GTTTCTGTAACATTTGGTCA | 16 | 642 |
| 1399216 | N/A | N/A | 85285 | 85304 | GCTGCTTATTTTCATCTAAT | 14 | 643 |
| 1399248 | N/A | N/A | 83591 | 83610 | CTCAACCTATACCACTATCC | 94 | 644 |
| 1399291 | N/A | N/A | 236468 | 236487 | TGTCAATTTTCCCTTTCATC | 21 | 645 |
| 1399331 | N/A | N/A | 48068 | 48087 | CACCATGCAGATTATCAGCT | 32 | 646 |
| 1399354 | N/A | N/A | 7248 | 7267 | TCTCATACTCTGCCCATCAA | 58 | 647 |
| 1399431 | N/A | N/A | 46666 | 46685 | AAAGACTTTCAAATTCTAGC | 55 | 648 |
| 1399449 | N/A | N/A | 4739 | 4758 | CTGCAGCCTCCACACAGCTT | 57 | 649 |
| 1399490 | N/A | N/A | 266251 | 266270 | TGCCTTGTACAAACTCTCTA | 50 | 650 |
| 1399515 | N/A | N/A | 136339 | 136358 | GCACTTAGTTCCACCATCAT | 46 | 651 |

TABLE 9

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 19 | 178 |
| 1397582 | N/A | N/A | 173495 | 173514 | TGCACATCACAACAATTCTC | 41 | 652 |
| 1397664 | 487 | 506 | N/A | N/A | ATGTCTCTTTGGCGACGGTG | 38 | 653 |
| 1397672 | N/A | N/A | 7253 | 7272 | GTTCATCTCATACTCTGCCC | 31 | 654 |
| 1397684 | N/A | N/A | 266253 | 266272 | GCTGCCTTGTACAAACTCTC | 69 | 655 |
| 1397697 | N/A | N/A | 277244 | 277263 | GCTGCTGTCTTCTTTGCACA | 40 | 656 |
| 1397699 | N/A | N/A | 46722 | 46741 | GCACTCATAACTAGGGTTCC | 51 | 657 |
| 1397705 | N/A | N/A | 12535 | 12554 | CCTCCTTTTTATTCTGTCTA | 40 | 658 |
| 1397716 | N/A | N/A | 76749 | 76768 | CCTGACCACTTGCTACCTCC | 77 | 659 |
| 1397733 | N/A | N/A | 283790 | 283809 | TTCCTTCCTCACACTGCTCA | 70 | 660 |
| 1397734 | N/A | N/A | 236609 | 236628 | GCACATGTTTTCTTTGTAAC | 34 | 661 |

TABLE 9-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1397783 | N/A | N/A | 27083 | 27102 | ACCCACCTTCCTTCTATGTA | 73 | 662 |
| 1397786 | N/A | N/A | 8088 | 8107 | TTGATGCACATATCCAGGCT | 12 | 663 |
| 1397928 | N/A | N/A | 153231 | 153250 | ATGCATACTCTTTAAGGAAC | 35 | 664 |
| 1397933 | N/A | N/A | 54055 | 54074 | GCTAGGACAGATTAGCACCC | 25 | 665 |
| 1397950 | 672 | 691 | 122977 | 122996 | ATCTGCATAGTCTGTGTCTG | 33† | 666 |
| 1397955 | N/A | N/A | 5176 | 5195 | AACCTGTCTTAACTAGCCCT | 44 | 667 |
| 1398059 | N/A | N/A | 103466 | 103485 | GGTATCTGTCTACACCTGCT | 42 | 668 |
| 1398076 | N/A | N/A | 25053 | 25072 | TGTGACTCAGATCCAAGGTC | 30 | 669 |
| 1398092 | N/A | N/A | 228780 | 228799 | AGCATGCTAAATCAGTTCTC | 41 | 670 |
| 1398162 | N/A | N/A | 59439 | 59458 | AGGGCATCACAATTCTTCAT | 54 | 671 |
| 1398177 | N/A | N/A | 50216 | 50235 | CTGCAGTCTTACTCTTGGAT | 50 | 672 |
| 1398185 | N/A | N/A | 96751 | 96770 | TGTCTCTTCTGCAACTTACT | 37 | 673 |
| 1398202 | N/A | N/A | 271283 | 271302 | GGGTTAGTACTCCATCTCCT | 43 | 674 |
| 1398229 | N/A | N/A | 248590 | 248609 | CCCTTCGCTTTGAATCCTTT | 70 | 675 |
| 1398243 | N/A | N/A | 38643 | 38662 | ATGCACGACTTCTATAACTT | 36 | 676 |
| 1398262 | N/A | N/A | 101648 | 101667 | GGTTTCCGGATTATTTCACA | 16 | 677 |
| 1398291 | N/A | N/A | 51927 | 51946 | AGTTGCTGATATACTTGGAC | 38 | 678 |
| 1398296 | N/A | N/A | 32657 | 32676 | ACAGTTTCTTGATTTTTCCC | 41 | 679 |
| 1398310 | N/A | N/A | 181219 | 181238 | CATCACATCTTTTAATGCTT | 76 | 680 |
| 1398331 | N/A | N/A | 92226 | 92245 | TGCTCATTACCCATCCTTAT | 50 | 681 |
| 1398409 | N/A | N/A | 36412 | 36431 | GAGCTCTTTCCTCACTGGGA | 48 | 682 |
| 1398441 | N/A | N/A | 28296 | 28315 | TCCAATGTTCTCATTGCCCA | 35 | 683 |
| 1398444 | N/A | N/A | 30251 | 30270 | CCACCCTTCTACTCTTGTTT | 58 | 684 |
| 1398463 | N/A | N/A | 66424 | 66443 | TCCTATCCTATCTCTCTGGC | 63 | 685 |
| 1398468 | N/A | N/A | 167726 | 167745 | ATTTCTTACACTTTCAAGAT | 69 | 686 |
| 1398472 | N/A | N/A | 219500 | 219519 | GCTGTTCTATTAACTTCCAT | 27 | 687 |
| 1398481 | N/A | N/A | 34438 | 34457 | ATCTGATTTTGAAACCAGTC | 31 | 688 |
| 1398487 | N/A | N/A | 16323 | 16342 | GTATCTTCATTTAATCACTT | 30 | 689 |
| 1398515 | N/A | N/A | 15501 | 15520 | GAGCACATTTACATGCTCCC | 85 | 690 |
| 1398517 | N/A | N/A | 48077 | 48096 | CTGGACTCTCACCATGCAGA | 46 | 691 |
| 1398545 | N/A | N/A | 13730 | 13749 | CCTCCACAATTCAACTAGCA | 59 | 692 |
| 1398549 | N/A | N/A | 158960 | 158979 | GTGCAGATATTTCAATATAC | 26 | 693 |
| 1398607 | N/A | N/A | 95375 | 95394 | TCATATTCTTCATCTGGCTA | 66 | 694 |
| 1398620 | N/A | N/A | 19474 | 19493 | ACTCTATTCATCCTACCCCA | 40 | 695 |
| 1398631 | N/A | N/A | 24067 | 24086 | CCTCACAGCCTTTACACTGT | 57 | 696 |
| 1398656 | N/A | N/A | 131385 | 131404 | TTGTTATCAAGATTTCACCC | 34 | 697 |

TABLE 9-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398665 | N/A | N/A | 41114 | 41133 | TCCTAGTGCATCATATTCTA | 64 | 698 |
| 1398712 | N/A | N/A | 22560 | 22579 | TTTGAACTACTAGATCAGCC | 33 | 699 |
| 1398726 | N/A | N/A | 286123 | 286142 | GCACAGCGATCAAACCGCCC | 56 | 700 |
| 1398740 | N/A | N/A | 85286 | 85305 | TGCTGCTTATTTTCATCTAA | 34 | 701 |
| 1398744 | N/A | N/A | 207876 | 207895 | CCACTAGTATCTCTTGTTAC | 37 | 702 |
| 1398827 | N/A | N/A | 197165 | 197184 | GGTGATTCAGTCTCTGTCCT | 66 | 703 |
| 1398847 | N/A | N/A | 10186 | 10205 | GCTTTCAAATATCCTTGGCC | 30 | 704 |
| 1398880 | N/A | N/A | 20339 | 20358 | CCATGAATCCTCTAAGCATT | 45 | 705 |
| 1398889 | N/A | N/A | 104397 | 104416 | CCAGCCTATTTCTCTCCTAA | 49 | 706 |
| 1398900 | N/A | N/A | 177974 | 177993 | TTGTGCCTCTTCTTCCAGCA | 35 | 707 |
| 1398901 | N/A | N/A | 211495 | 211514 | GCAGAATATCCTTCATAGTC | 39 | 708 |
| 1398951 | N/A | N/A | 83772 | 83791 | GTCTCTGACTTTTTCCGATT | 64 | 709 |
| 1398979 | N/A | N/A | 136341 | 136360 | CTGCACTTAGTTCCACCATC | 37 | 710 |
| 1399015 | N/A | N/A | 154739 | 154758 | AAGGTCTCTATATTTTGGTC | 29 | 711 |
| 1399054 | N/A | N/A | 10452 | 10471 | CTCCACTCCTGCTTCTGGAA | 71 | 712 |
| 1399055 | 1147 | 1166 | 191546 | 191565 | ACTTGTCAACGGCATCAGGG | 52 | 713 |
| 1399086 | N/A | N/A | 88706 | 88725 | CTGGTCATTCCTTATGAGAC | 76 | 714 |
| 1399090 | N/A | N/A | 98900 | 98919 | GCTGCTCCACATCTTCTGTC | 39 | 715 |
| 1399100 | N/A | N/A | 223642 | 223661 | CTTTTCAAGCAAGGAAAAAC | 75 | 716 |
| 1399144 | N/A | N/A | 104785 | 104804 | TCTCAATAGATACTTATCGC | 51 | 717 |
| 1399155 | N/A | N/A | 186702 | 186721 | GCTCACTCATGCCTTCTGCA | 59 | 718 |
| 1399158 | N/A | N/A | 31692 | 31711 | GCACCACCACACAGCCCTCA | 90 | 719 |
| 1399222 | N/A | N/A | 161363 | 161382 | CACAGCTTTGTAACCTGCTC | 29 | 720 |
| 1399280 | N/A | N/A | 43544 | 43563 | CAGCAAGGCCACTCTCCATA | 73 | 721 |
| 1399315 | N/A | N/A | 274952 | 274971 | CTAGCACCATTTCCTCATCC | 57 | 722 |
| 1399337 | N/A | N/A | 90302 | 90321 | CCTTGGGACAATATCATGCC | 41 | 723 |
| 1399339 | N/A | N/A | 106107 | 106126 | TGGTTGCTTTCTCCTAACAC | 69 | 724 |
| 1399382 | N/A | N/A | 87095 | 87114 | CTGTAGTGCTGACTCTCCCA | 60 | 725 |
| 1399415 | N/A | N/A | 116885 | 116904 | GCTGTGAACTTCCACTGCTT | 60 | 726 |
| 1399419 | N/A | N/A | 262030 | 262049 | AAGCAGCTCATCTAAACCAA | 69 | 727 |
| 1399499 | N/A | N/A | 291487 | 291506 | GTTGCTTTACCTCTAAGGTC | 38 | 728 |

TABLE 10

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 22 | 178 |
| 1396900 | N/A | N/A | 96766 | 96785 | GCCATCTCATTTAGTTGTCT | 34 | 729 |
| 1397542 | N/A | N/A | 5589 | 5608 | CCCTTCTACCAACACTTCGC | 43 | 730 |
| 1397603 | 674 | 693 | 122979 | 122998 | CCATCTGCATAGTCTGTGTC | 8† | 731 |
| 1397611 | N/A | N/A | 10202 | 10221 | GTTTCATACACTCAAGGCTT | 55 | 732 |
| 1397679 | N/A | N/A | 223644 | 223663 | AACTTTTCAAGCAAGGAAAA | 98 | 733 |
| 1397688 | N/A | N/A | 286281 | 286300 | ACGCAAATCCCTGCCAGTGT | 55 | 734 |
| 1397712 | N/A | N/A | 87234 | 87253 | GTCTCCTCTGTCAACACAAC | 33 | 735 |
| 1397730 | N/A | N/A | 90345 | 90364 | CCATTAGCCTTGCTATTCAT | 55 | 736 |
| 1397755 | N/A | N/A | 46765 | 46784 | TGGTAACTATTTCTGGGCAA | 41 | 737 |
| 1397780 | N/A | N/A | 136363 | 136382 | GTGGTCTCAGCATCCTGTTC | 61 | 738 |
| 1397794 | N/A | N/A | 186707 | 186726 | AGCCTGCTCACTCATGCCTT | 62 | 739 |
| 1397810 | 1148 | 1167 | 191547 | 191566 | TACTTGTCAACGGCATCAGG | 54 | 740 |
| 1397827 | N/A | N/A | 104398 | 104417 | TCCAGCCTATTTCTCTCCTA | 62 | 741 |
| 1397875 | N/A | N/A | 59746 | 59765 | GCACTTGATTCCATTTCCTC | 60 | 742 |
| 1397903 | N/A | N/A | 54223 | 54242 | TGCTAAGATCTCATTCTAGA | 60 | 743 |
| 1397908 | N/A | N/A | 12566 | 12585 | CCCAACTTAATTTTTTCCAA | 29 | 744 |
| 1397921 | N/A | N/A | 88810 | 88829 | GTTGACCATTCAAAGGTCCC | 26 | 745 |
| 1397961 | N/A | N/A | 36626 | 36645 | TCCCATCTAAATTTTGCTTT | 62 | 746 |
| 1397984 | N/A | N/A | 178256 | 178275 | ATGCTTTTTCACAACAGCA | 35 | 747 |
| 1398100 | N/A | N/A | 16368 | 16387 | ACAGGTTTTCCCCACATCTT | 43 | 748 |
| 1398101 | N/A | N/A | 41191 | 41210 | ACACCATCACAACAGAACCC | 51 | 749 |
| 1398116 | N/A | N/A | 103557 | 103576 | TCACCAACTCTTCTTTAGCA | 41 | 750 |
| 1398120 | N/A | N/A | 7255 | 7274 | CTGTTCATCTCATACTCTGC | 49 | 751 |
| 1398124 | N/A | N/A | 66434 | 66453 | GCCTCCTACTTCCTATCCTA | 69 | 752 |
| 1398155 | N/A | N/A | 22565 | 22584 | GCTTGTTTGAACTACTAGAT | 56 | 753 |
| 1398182 | N/A | N/A | 98901 | 98920 | TGCTGCTCCACATCTTCTGT | 49 | 754 |
| 1398260 | N/A | N/A | 161377 | 161396 | TCTCCATTCAAATCCACAGC | 47 | 755 |
| 1398280 | N/A | N/A | 27096 | 27115 | TGGGTAAATAATTACCCACC | 80 | 756 |
| 1398298 | N/A | N/A | 213022 | 213041 | GGTAGTTATCTCTATCCCTC | 42 | 757 |
| 1398300 | N/A | N/A | 10457 | 10476 | GAACCCTCCACTCCTGCTTC | 67 | 758 |
| 1398313 | N/A | N/A | 291771 | 291790 | GGTGACACTCAAATCTGTGT | 52 | 759 |
| 1398334 | N/A | N/A | 283828 | 283847 | CCGTTCCTTTCCACCCTGCT | 58 | 760 |
| 1398343 | N/A | N/A | 50217 | 50236 | ACTGCAGTCTTACTCTTGGA | 70 | 761 |
| 1398360 | N/A | N/A | 28297 | 28316 | TTCCAATGTTCTCATTGCCC | 26 | 762 |
| 1398425 | N/A | N/A | 104812 | 104831 | GAGGTCATAAAAATCATGCT | 57 | 763 |

TABLE 10-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398451 | N/A | N/A | 271286 | 271305 | CCTGGGTTAGTACTCCATCT | 47 | 764 |
| 1398589 | N/A | N/A | 281185 | 281204 | CACCACAACTTTTATCATCT | 27 | 765 |
| 1398591 | N/A | N/A | 219603 | 219622 | GGCGACATTCCTCCAGTCTT | 30 | 766 |
| 1398598 | 1765 | 1784 | 262082 | 262101 | GTTCACTAATCATGTTGGCC | 62 | 767 |
| 1398602 | N/A | N/A | 38722 | 38741 | ACCAGACCTTCTCACTTCGA | 64 | 768 |
| 1398618 | N/A | N/A | 158961 | 158980 | AGTGCAGATATTTCAATATA | 40 | 769 |
| 1398621 | N/A | N/A | 15502 | 15521 | AGAGCACATTTACATGCTCC | 92 | 770 |
| 1398640 | N/A | N/A | 85287 | 85306 | GTGCTGCTTATTTTCATCTA | 40 | 771 |
| 1398690 | N/A | N/A | 8089 | 8108 | ATTGATGCACATATCCAGGC | 26 | 772 |
| 1398692 | N/A | N/A | 48079 | 48098 | ATCTGGACTCTCACCATGCA | 53 | 773 |
| 1398770 | N/A | N/A | 30253 | 30272 | CACCACCCTTCTACTCTTGT | 61 | 774 |
| 1398804 | N/A | N/A | 95377 | 95396 | TTTCATATTCTTCATCTGGC | 35 | 775 |
| 1398851 | N/A | N/A | 153295 | 153314 | AAGCATCTTTTACTATCTGC | 65 | 776 |
| 1398860 | N/A | N/A | 83789 | 83808 | CCAGAAGTGCTTTCAAGGTC | 82 | 777 |
| 1398866 | N/A | N/A | 208224 | 208243 | GCAGGTGAATAACTACTGGA | 31 | 778 |
| 1398867 | N/A | N/A | 34538 | 34557 | CCAGACTCTACTCAAGGTTT | 45 | 779 |
| 1398905 | N/A | N/A | 275135 | 275154 | GCTCTTGGCCTAATCACTCT | 82 | 780 |
| 1398952 | N/A | N/A | 167728 | 167747 | GAATTTCTTACACTTTCAAG | 50 | 781 |
| 1398962 | N/A | N/A | 117302 | 117321 | TTAGCTTCTTATATTGCACA | 73 | 782 |
| 1399016 | N/A | N/A | 248595 | 248614 | GCAGTCCCTTCGCTTTGAAT | 50 | 783 |
| 1399021 | N/A | N/A | 20340 | 20359 | GCCATGAATCCTCTAAGCAT | 34 | 784 |
| 1399121 | N/A | N/A | 131437 | 131456 | GCCACCTACAAATTGAGCCT | 42 | 785 |
| 1399125 | N/A | N/A | 25099 | 25118 | CTTACATCATTTTCTTGCAG | 71 | 786 |
| 1399137 | N/A | N/A | 106309 | 106328 | TTGCAGTTCTCATATCATAA | 21 | 787 |
| 1399156 | N/A | N/A | 174177 | 174196 | TGGCCATGCTTTATCAGGGA | 57 | 788 |
| 1399173 | N/A | N/A | 101704 | 101723 | TTACACTCATTTTAGTAGC | 49 | 789 |
| 1399197 | N/A | N/A | 92227 | 92246 | ATGCTCATTACCCATCCTTA | 41 | 790 |
| 1399227 | N/A | N/A | 31693 | 31712 | TGCACCACCACACAGCCCTC | 79 | 791 |
| 1399232 | N/A | N/A | 228781 | 228800 | TAGCATGCTAAATCAGTTCT | 37 | 792 |
| 1399237 | 489 | 508 | N/A | N/A | GCATGTCTCTTTGGCGACGG | 43 | 793 |
| 1399238 | N/A | N/A | 32729 | 32748 | GTACAAGCACAGATTAACTC | 40 | 794 |
| 1399275 | N/A | N/A | 154740 | 154759 | GAAGGTCTCTATATTTTGGT | 48 | 795 |
| 1399279 | N/A | N/A | 78498 | 78517 | CGTAGTGTCATAATTGCTCT | 59 | 796 |
| 1399282 | N/A | N/A | 197970 | 197989 | TCCCATTCTCTCATGACCTA | 48 | 797 |
| 1399297 | N/A | N/A | 13861 | 13880 | CTACTCTATCATCACCTGGA | 67 | 798 |
| 1399303 | N/A | N/A | 51952 | 51971 | CCATACTGATAAATCTGCAT | 71 | 799 |

TABLE 10-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1399318 | N/A | N/A | 266509 | 266528 | ACTTCATCAATGAAGTGCTA | 45 | 800 |
| 1399334 | N/A | N/A | 24084 | 24103 | ACCCCAGCATGCTCCCACCT | 91 | 801 |
| 1399348 | N/A | N/A | 19476 | 19495 | TAACTCTATTCATCCTACCC | 101 | 802 |
| 1399391 | N/A | N/A | 236644 | 236663 | TGCTTCTCAGGATTCGCACC | 41 | 803 |
| 1399420 | N/A | N/A | 43883 | 43902 | GCATCACACAACAGCTGACA | 41 | 804 |
| 1399447 | N/A | N/A | 181234 | 181253 | GGTAGTTTAATTCACCATCA | 47 | 805 |

TABLE 11

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 21 | 178 |
| 1397526 | 675 | 694 | 122980 | 122999 | CCCATCTGCATAGTCTGTGT | 6† | 806 |
| 1397589 | N/A | N/A | 25214 | 25233 | CCAGGGCCTACTCCTGGCCA | 92 | 807 |
| 1397630 | N/A | N/A | 83865 | 83884 | GCTGGCATTTACAAGCATCT | 93 | 808 |
| 1397644 | N/A | N/A | 92228 | 92247 | AATGCTCATTACCCATCCTT | 63 | 809 |
| 1397696 | N/A | N/A | 178301 | 178320 | AGTCTGTCAACCCACTTGCT | 78 | 810 |
| 1397720 | N/A | N/A | 267011 | 267030 | TGCTAATGTCACCACTTACT | 63 | 811 |
| 1397728 | N/A | N/A | 99000 | 99019 | TTGTTACATAAAACCTGCTC | 84 | 812 |
| 1397744 | N/A | N/A | 101944 | 101963 | GTTGACTATTTATATAAGTC | 46 | 813 |
| 1397787 | N/A | N/A | 117540 | 117559 | ACTCTTACTTTCATCTGGCA | 74 | 814 |
| 1397790 | 1769 | 1788 | 262086 | 262105 | CTTGGTTCACTAATCATGTT | 84 | 815 |
| 1397835 | N/A | N/A | 30257 | 30276 | GTAACACCACCCTTCTACTC | 78 | 816 |
| 1397847 | N/A | N/A | 38726 | 38745 | CAGCACCAGACCTTCTCACT | 30 | 817 |
| 1397852 | N/A | N/A | 59748 | 59767 | ATGCACTTGATTCCATTTCC | 58 | 818 |
| 1397866 | N/A | N/A | 154741 | 154760 | TGAAGGTCTCTATATTTTGG | 34 | 819 |
| 1397890 | 490 | 509 | N/A | N/A | TGCATGTCTCTTTGGCGACG | 65 | 820 |
| 1397976 | N/A | N/A | 199218 | 199237 | GCCATCAATTGTCACCACCT | 54 | 821 |
| 1397986 | N/A | N/A | 286286 | 286305 | TAGATACGCAAATCCCTGCC | 88 | 822 |
| 1398001 | N/A | N/A | 85440 | 85459 | AGACTCATGATCTACTTCCT | 42 | 823 |
| 1398005 | N/A | N/A | 12584 | 12603 | ATTCTCTTATATTCCTTACC | 51 | 824 |
| 1398011 | N/A | N/A | 213023 | 213042 | TGGTAGTTATCTCTATCCCT | 43 | 825 |
| 1398015 | N/A | N/A | 48250 | 48269 | ATCCCATTCTGTCTAGCCCC | 68 | 826 |
| 1398019 | N/A | N/A | 13864 | 13883 | TGGCTACTCTATCATCACCT | 65 | 827 |
| 1398023 | N/A | N/A | 7259 | 7278 | GCCACTGTTCATCTCATACT | 32 | 828 |

TABLE 11-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398032 | N/A | N/A | 219852 | 219871 | GTGCTACTTATAATGCATGT | 50 | 829 |
| 1398045 | N/A | N/A | 10203 | 10222 | AGTTTCATACACTCAAGGCT | 38 | 830 |
| 1398108 | 1149 | 1168 | 191548 | 191567 | ATACTTGTCAACGGCATCAG | 62 | 831 |
| 1398211 | N/A | N/A | 88811 | 88830 | CGTTGACCATTCAAAGGTCC | 75 | 832 |
| 1398284 | N/A | N/A | 162414 | 162433 | CCGCAACAATTATCTGGCCC | 31 | 833 |
| 1398323 | N/A | N/A | 50423 | 50442 | GCTCTCCCTTTGTAGAGCCC | 85 | 834 |
| 1398354 | N/A | N/A | 41284 | 41303 | CTTGATTACTTCAACTTAGT | 66 | 835 |
| 1398390 | N/A | N/A | 16369 | 16388 | TACAGGTTTTCCCCACATCT | 42 | 836 |
| 1398417 | N/A | N/A | 238484 | 238503 | TCCAGCAGTATCCACCTGCT | 101 | 837 |
| 1398432 | N/A | N/A | 275150 | 275169 | GGGAATTCACTTCCTGCTCT | 70 | 838 |
| 1398453 | N/A | N/A | 104399 | 104418 | GTCCAGCCTATTTCTCTCCT | 15 | 839 |
| 1398460 | N/A | N/A | 19477 | 19496 | GTAACTCTATTCATCCTACC | 51 | 840 |
| 1398484 | N/A | N/A | 167730 | 167749 | TTGAATTTCTTACACTTTCA | 66 | 841 |
| 1398498 | N/A | N/A | 8112 | 8131 | ATCCCTGTTTCATAAAGCTA | 42 | 842 |
| 1398525 | N/A | N/A | 51953 | 51972 | GCCATACTGATAAATCTGCA | 46 | 843 |
| 1398554 | N/A | N/A | 283831 | 283850 | AGTCCGTTCCTTTCCACCCT | 69 | 844 |
| 1398576 | N/A | N/A | 31694 | 31713 | CTGCACCACCACACAGCCCT | 92 | 845 |
| 1398604 | N/A | N/A | 158963 | 158982 | TAAGTGCAGATATTTCAATA | 40 | 846 |
| 1398619 | N/A | N/A | 95409 | 95428 | GCTGTCTGTACCACTCTAAA | 39 | 847 |
| 1398638 | N/A | N/A | 182231 | 182250 | CTTTCATGCTACCACTGCAT | 54 | 848 |
| 1398648 | N/A | N/A | 131438 | 131457 | TGCCACCTACAAAATTGAGCC | 61 | 849 |
| 1398660 | N/A | N/A | 66435 | 66454 | CGCCTCCTACTTCCTATCCT | 72 | 850 |
| 1398675 | N/A | N/A | 174406 | 174425 | TCAAGCTGCATCAGCCAGGC | 49 | 851 |
| 1398682 | N/A | N/A | 153965 | 153984 | TCCATCTTGCACTCTGTTCT | 38 | 852 |
| 1398779 | N/A | N/A | 20341 | 20360 | AGCCATGAATCCTCTAAGCA | 25 | 853 |
| 1398801 | N/A | N/A | 248601 | 248620 | GTTCTTGCAGTCCCTTCGCT | 41 | 854 |
| 1398813 | N/A | N/A | 47184 | 47203 | GAGTCATGTCTTACTGTTCT | 44 | 855 |
| 1398833 | N/A | N/A | 22636 | 22655 | GTCAAATGCAACAACTTACA | 49 | 856 |
| 1398836 | N/A | N/A | 106310 | 106329 | GTTGCAGTTCTCATATCATA | 29 | 857 |
| 1398863 | N/A | N/A | 24092 | 24111 | CTTCCAACACCCCAGCATGC | 75 | 858 |
| 1398912 | N/A | N/A | 104841 | 104860 | CCCGTTGATCGATTTCCCCA | 87 | 859 |
| 1398957 | N/A | N/A | 90350 | 90369 | GATGTCCATTAGCCTTGCTA | 44 | 860 |
| 1398971 | N/A | N/A | 15580 | 15599 | ACTCAATATCCTACCTCTCC | 72 | 861 |
| 1398978 | N/A | N/A | 87240 | 87259 | ATGGTTGTCTCCTCTGTCAA | 42 | 862 |
| 1398988 | N/A | N/A | 28304 | 28323 | TCCTCCATTCCAATGTTCTC | 54 | 863 |
| 1399031 | N/A | N/A | 136850 | 136869 | ACCACATGCTCTCATATGCA | 63 | 864 |

TABLE 11-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1399117 | N/A | N/A | 78587 | 78606 | GCCATTGATCACTTCATCAC | 79 | 865 |
| 1399118 | N/A | N/A | 5704 | 5723 | GCAGACCTATTTTCTAAGCT | 25 | 866 |
| 1399165 | N/A | N/A | 103651 | 103670 | GCAGGACTTATCACTCCACA | 40 | 867 |
| 1399191 | N/A | N/A | 97296 | 97315 | GCTCAATTAAACCACAGTTT | 33 | 868 |
| 1399194 | N/A | N/A | 223645 | 223664 | CAACTTTTCAAGCAAGGAAA | 45 | 869 |
| 1399208 | N/A | N/A | 10463 | 10482 | GCTCATGAACCCTCCACTCC | 78 | 870 |
| 1399215 | N/A | N/A | 291914 | 291933 | ATGGTATTTTTTCCTCCCCT | 44 | 871 |
| 1399235 | N/A | N/A | 36627 | 36646 | ATCCCATCTAAATTTTGCTT | 78 | 872 |
| 1399283 | N/A | N/A | 34543 | 34562 | TTGCACCAGACTCTACTCAA | 61 | 873 |
| 1399320 | N/A | N/A | 281267 | 281286 | CTGCACTACATTGCTTCATA | 62 | 874 |
| 1399321 | N/A | N/A | 271407 | 271426 | GCTTAGGCCACCCTCTCTTC | 95 | 875 |
| 1399365 | N/A | N/A | 27132 | 27151 | CTGGGTACATAATACTAGGT | 23 | 876 |
| 1399368 | N/A | N/A | 186890 | 186909 | TGGCAAAACAACCATATGCT | 62 | 877 |
| 1399377 | N/A | N/A | 32758 | 32777 | TTGGTTCATTATTTAAGCTT | 29 | 878 |
| 1399399 | N/A | N/A | 228782 | 228801 | ATAGCATGCTAAATCAGTTC | 42 | 879 |
| 1399448 | N/A | N/A | 54343 | 54362 | CTGCTATACAGCTACTTGTA | 82 | 880 |
| 1399485 | N/A | N/A | 208241 | 208260 | TCTATCAGTCATACCAGGCA | 45 | 881 |
| 1399507 | N/A | N/A | 44380 | 44399 | CACAAATTTTATCACATCCC | 89 | 882 |

TABLE 12

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 16 | 178 |
| 1397565 | N/A | N/A | 54943 | 54962 | GCTCATTATCTCATTTGACT | 54 | 883 |
| 1397590 | N/A | N/A | 27146 | 27165 | GCTGACAAACTGTACTGGGT | 31 | 884 |
| 1397602 | N/A | N/A | 15582 | 15601 | CCACTCAATATCCTACCTCT | 56 | 885 |
| 1397638 | N/A | N/A | 16370 | 16389 | CTACAGGTTTTCCCCACATC | 47 | 886 |
| 1397646 | N/A | N/A | 85572 | 85591 | GCCCATCCAAAGCCCTACCT | 51 | 887 |
| 1397648 | N/A | N/A | 88961 | 88980 | GCTACTCATTTATTATACAA | 29 | 888 |
| 1397671 | N/A | N/A | 131531 | 131550 | CATCTATAATACCATCTGGT | 43 | 889 |
| 1397694 | N/A | N/A | 154031 | 154050 | TAGCACATTTACTTATGTGC | 91 | 890 |
| 1397702 | N/A | N/A | 30260 | 30279 | CTGGTAACACCACCCTTCTA | 99 | 891 |
| 1397704 | 1150 | 1169 | 191549 | 191568 | GATACTTGTCAACGGCATCA | 41 | 892 |

TABLE 12-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1397710 | N/A | N/A | 223646 | 223665 | GCAACTTTTCAAGCAAGGAA | 21 | 893 |
| 1397721 | N/A | N/A | 59835 | 59854 | GCCTCAAACTCTCTCTGTAC | 89 | 894 |
| 1397745 | N/A | N/A | 22653 | 22672 | TCCAGCTACATTTGCCTGTC | 43 | 895 |
| 1397753 | N/A | N/A | 34544 | 34563 | CTTGCACCAGACTCTACTCA | 49 | 896 |
| 1397782 | N/A | N/A | 199233 | 199252 | TCGAACTTGAACTATGCCAT | 37 | 897 |
| 1397821 | N/A | N/A | 12589 | 12608 | GTAGCATTCTCTTATATTCC | 24 | 898 |
| 1397854 | 1770 | 1789 | 262087 | 262106 | CCTTGGTTCACTAATCATGT | 51 | 899 |
| 1397860 | N/A | N/A | 50509 | 50528 | CCAGGTTTAAATTCCAGGTT | 19 | 900 |
| 1397873 | N/A | N/A | 281352 | 281371 | ATGTTGCTTTATTCTTGCTC | 45 | 901 |
| 1397882 | N/A | N/A | 44382 | 44401 | TGCACAAATTTTATCACATC | 45 | 902 |
| 1397936 | N/A | N/A | 286566 | 286585 | GCACAGTTACCTCCTTGGGA | 33 | 903 |
| 1397949 | N/A | N/A | 20342 | 20361 | AAGCCATGAATCCTCTAAGC | 43 | 904 |
| 1397989 | N/A | N/A | 10464 | 10483 | TGCTCATGAACCCTCCACTC | 84 | 905 |
| 1398009 | N/A | N/A | 106333 | 106352 | GCTCATCTCCCCCCATTTCT | 85 | 906 |
| 1398073 | N/A | N/A | 178316 | 178335 | CTAGAGCTTTTTCCTAGTCT | 44 | 907 |
| 1398225 | N/A | N/A | 183299 | 183318 | GATTTCATTTTACCCCAGCC | 39 | 908 |
| 1398241 | N/A | N/A | 275456 | 275475 | AGTCATCTTCTCTACCGTGT | 60 | 909 |
| 1398251 | N/A | N/A | 208257 | 208276 | TGCTACCCATCTGTTCTCTA | 44 | 910 |
| 1398259 | N/A | N/A | 8147 | 8166 | CCTCTCTGAATACTCAGCTA | 43 | 911 |
| 1398267 | N/A | N/A | 10204 | 10223 | CAGTTTCATACACTCAAGGC | 29 | 912 |
| 1398326 | N/A | N/A | 213471 | 213490 | GCTGGCTTTTTTTAGCTTT | 63 | 913 |
| 1398335 | N/A | N/A | 87241 | 87260 | CATGGTTGTCTCCTCTGTCA | 23 | 914 |
| 1398368 | N/A | N/A | 48252 | 48271 | ACATCCCATTCTGTCTAGCC | 57 | 915 |
| 1398370 | N/A | N/A | 33011 | 33030 | GCATAGGTTTAAATTCTAAC | 33 | 916 |
| 1398398 | N/A | N/A | 187170 | 187189 | CCTCTTTTCATCAGAGCCCA | 66 | 917 |
| 1398405 | N/A | N/A | 95443 | 95462 | AAGCTACTCTTCTACCCCAA | 45 | 918 |
| 1398442 | N/A | N/A | 256336 | 256355 | ACAGCTTCTTCCATCCACTG | 72 | 919 |
| 1398450 | N/A | N/A | 47214 | 47233 | CTCCAACCTAAGCCTTTACT | 88 | 920 |
| 1398478 | N/A | N/A | 31695 | 31714 | GCTGCACCACCACACAGCCC | 74 | 921 |
| 1398483 | N/A | N/A | 228784 | 228803 | TGATAGCATGCTAAATCAGT | 42 | 922 |
| 1398527 | N/A | N/A | 104869 | 104888 | TTGGTTGTAGAACCCAACCA | 116 | 923 |
| 1398536 | N/A | N/A | 97312 | 97331 | GCATACAACAAACTCAGCTC | 37 | 924 |
| 1398548 | N/A | N/A | 103653 | 103672 | TGGCAGGACTTATCACTCCA | 22 | 925 |
| 1398553 | N/A | N/A | 92231 | 92250 | CTTAATGCTCATTACCCATC | 66 | 926 |
| 1398558 | N/A | N/A | 24095 | 24114 | CTTCTTCCAACACCCCAGCA | 75 | 927 |
| 1398564 | 279 | 298 | 83948 | 83967 | GGCTTCTACCACATTGGTGA | 32 | 928 |

TABLE 12-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398608 | N/A | N/A | 283832 | 283851 | CAGTCCGTTCCTTTCCACCC | 55 | 929 |
| 1398615 | N/A | N/A | 104400 | 104419 | GGTCCAGCCTATTTCTCTCC | 33 | 930 |
| 1398639 | N/A | N/A | 122796 | 122815 | CTGCATGTCTACAAAGTGTA | 76 | 931 |
| 1398662 | N/A | N/A | 162429 | 162448 | GCACAGGACAATCATCCGCA | 27 | 932 |
| 1398664 | N/A | N/A | 219948 | 219967 | ACTCATGGCTTCCCTGCTCA | 60 | 933 |
| 1398689 | N/A | N/A | 137243 | 137262 | GCTCTGTTCTAGTACAACCA | 42 | 934 |
| 1398697 | N/A | N/A | 41313 | 41332 | GATGGTCTCACCCAAAGAAC | 69 | 935 |
| 1398802 | N/A | N/A | 13865 | 13884 | ATGGCTACTCTATCATCACC | 72 | 936 |
| 1398830 | N/A | N/A | 38852 | 38871 | CCTTCTTACAATTATGCTCT | 74 | 937 |
| 1398840 | N/A | N/A | 7260 | 7279 | TGCCACTGTTCATCTCATAC | 32 | 938 |
| 1398878 | N/A | N/A | 174492 | 174511 | TCACATTCCCTCATCAGCAC | 72 | 939 |
| 1398914 | N/A | N/A | 167732 | 167751 | TGTTGAATTTCTTACACTTT | 50 | 940 |
| 1398919 | N/A | N/A | 90363 | 90382 | GTACTACAAATCAGATGTCC | 40 | 941 |
| 1398990 | N/A | N/A | 28306 | 28325 | TCTCCTCCATTCCAATGTTC | 37 | 942 |
| 1399072 | N/A | N/A | 291954 | 291973 | TGGTTCCCCAACTCCACAGT | 58 | 943 |
| 1399079 | N/A | N/A | 154743 | 154762 | ATTGAAGGTCTCTATATTTT | 48 | 944 |
| 1399151 | N/A | N/A | 52321 | 52340 | ATGCAATATCATATTCATCA | 28 | 945 |
| 1399157 | N/A | N/A | 238498 | 238517 | ACTTTGTTATACTATCCAGC | 34 | 946 |
| 1399196 | N/A | N/A | 36991 | 37010 | AAGAGATCCATCTCTGCTCA | 47 | 947 |
| 1399206 | N/A | N/A | 25225 | 25244 | CCCTCATTCATCCAGGGCCT | 28 | 948 |
| 1399246 | N/A | N/A | 5730 | 5749 | TCATTTCTTTTCTACAGCCA | 30 | 949 |
| 1399256 | N/A | N/A | 66493 | 66512 | TGCACTCTTATCTTTCCCCT | 40 | 950 |
| 1399268 | N/A | N/A | 102007 | 102026 | GGTTTATGTTCAAACTGTCT | 32 | 951 |
| 1399272 | N/A | N/A | 99137 | 99156 | ATGCCTCTGATACACTGACT | 37 | 952 |
| 1399312 | N/A | N/A | 78589 | 78608 | CTGCCATTGATCACTTCATC | 68 | 953 |
| 1399345 | N/A | N/A | 19478 | 19497 | GGTAACTCTATTCATCCTAC | 31 | 954 |
| 1399396 | N/A | N/A | 267016 | 267035 | GCCACTGCTAATGTCACCAC | 72 | 955 |
| 1399430 | N/A | N/A | 117541 | 117560 | TACTCTTACTTTCATCTGGC | 21 | 956 |
| 1399452 | 676 | 695 | 122981 | 123000 | TCCCATCTGCATAGTCTGTG | 3† | 957 |
| 1399482 | N/A | N/A | 271736 | 271755 | ACGGCATGACAATCTTGGGA | 37 | 958 |
| 1399483 | N/A | N/A | 159315 | 159334 | CAGCAACCAATGCCATGTCT | 41 | 959 |

TABLE 13

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 16 | 178 |
| 1394454 | 1151 | 1170 | 191550 | 191569 | AGATACTTGTCAACGGCATC | 40 | 960 |
| 1394557 | 677 | 696 | 122982 | 123001 | CTCCCATCTGCATAGTCTGT | 3T | 961 |
| 1397525 | N/A | N/A | 10208 | 10227 | TCACCAGTTTCATACACTCA | 28 | 962 |
| 1397548 | N/A | N/A | 19479 | 19498 | TGGTAACTCTATTCATCCTA | 41 | 963 |
| 1397550 | N/A | N/A | 80223 | 80242 | GCTTCTCTCTCTATAACACC | 72 | 964 |
| 1397596 | N/A | N/A | 228920 | 228939 | GAGGTGCCCACACATGCACA | 53 | 965 |
| 1397616 | N/A | N/A | 139947 | 139966 | GCACTGCTTTTCTATTTCCA | 92 | 966 |
| 1397627 | N/A | N/A | 88962 | 88981 | AGCTACTCATTTATTATACA | 46 | 967 |
| 1397661 | N/A | N/A | 33210 | 33229 | TGTTAATTCATAGACTCTCC | 40 | 968 |
| 1397673 | N/A | N/A | 283833 | 283852 | TCAGTCCGTTCCTTTCCACC | 93 | 969 |
| 1397674 | N/A | N/A | 7461 | 7480 | TCGGAACATTTATACTATTT | 28 | 970 |
| 1397675 | N/A | N/A | 187172 | 187191 | AGCCTCTTTTCATCAGAGCC | 51 | 971 |
| 1397676 | N/A | N/A | 54944 | 54963 | TGCTCATTATCTCATTTGAC | 37 | 972 |
| 1397756 | N/A | N/A | 22716 | 22735 | ATGCTCCCACTGAATGGCTC | 19 | 973 |
| 1397824 | N/A | N/A | 154041 | 154060 | GCGCATTTACTAGCACATTT | 14 | 974 |
| 1397883 | N/A | N/A | 5996 | 6015 | GCAGCAGGTTTCCATAAACT | 24 | 975 |
| 1397907 | N/A | N/A | 41368 | 41387 | CTGTTTAGTATTCACAACAT | 37 | 976 |
| 1397914 | N/A | N/A | 52343 | 52362 | GCCTTACAGATCCTCATCTT | 82 | 977 |
| 1397929 | N/A | N/A | 45391 | 45410 | TCATATCTAATTCAGTGTTC | 52 | 978 |
| 1397931 | N/A | N/A | 267020 | 267039 | ACGGGCCACTGCTAATGTCA | 45 | 979 |
| 1397940 | N/A | N/A | 104401 | 104420 | TGGTCCAGCCTATTTCTCTC | 19 | 980 |
| 1397970 | N/A | N/A | 95445 | 95464 | GTAAGCTACTCTTCTACCCC | 46 | 981 |
| 1398053 | N/A | N/A | 38853 | 38872 | CCCTTCTTACAATTATGCTC | 64 | 982 |
| 1398079 | N/A | N/A | 178317 | 178336 | GCTAGAGCTTTTTCCTAGTC | 40 | 983 |
| 1398132 | N/A | N/A | 50555 | 50574 | CCAAGATTACTTCTTTTCCT | 42 | 984 |
| 1398153 | N/A | N/A | 281405 | 281424 | GTCACTCATAACTCATGCTT | 76 | 985 |
| 1398246 | 2362 | 2381 | 292346 | 292365 | GCTGTCCAACTTCAGAGGCT | 43 | 986 |
| 1398293 | N/A | N/A | 106425 | 106444 | GCTATGCTATCTTAACGCAT | 48 | 987 |
| 1398325 | N/A | N/A | 87264 | 87283 | TGGAGATTATCCTATACTA | 34 | 988 |
| 1398339 | N/A | N/A | 8253 | 8272 | GCATGTTCTTCAACATGTA | 49 | 989 |
| 1398362 | 1772 | 1791 | 262089 | 262108 | ATCCTTGGTTCACTAATCAT | 82 | 990 |
| 1398375 | 491 | 510 | N/A | N/A | CTGCATGTCTCTTTGGCGAC | 33 | 991 |
| 1398376 | N/A | N/A | 131537 | 131556 | ATGCACCATCTATAATACCA | 41 | 992 |
| 1398399 | N/A | N/A | 97654 | 97673 | GCTCACAACAACCCCTCATA | 52 | 993 |
| 1398416 | N/A | N/A | 208267 | 208286 | GAGGATTCTTTGCTACCCAT | 51 | 994 |

TABLE 13-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398424 | N/A | N/A | 271750 | 271769 | ATGCCATCACTTGAACGGCA | 122 | 995 |
| 1398535 | N/A | N/A | 27288 | 27307 | GCACTATTCTCTCTTGTGTA | 44 | 996 |
| 1398626 | N/A | N/A | 102167 | 102186 | GGATCTTCATTCTCTAAGCT | 45 | 997 |
| 1398635 | N/A | N/A | 258189 | 258208 | GCTGTAGTACCCTTTTCTCT | 46 | 998 |
| 1398681 | N/A | N/A | 183302 | 183321 | GCTGATTTCATTTTACCCCA | 27 | 999 |
| 1398687 | N/A | N/A | 219992 | 220011 | GCCCACTATCTTTTAAGTTT | 28 | 1000 |
| 1398707 | N/A | N/A | 92232 | 92251 | CCTTAATGCTCATTACCCAT | 68 | 1001 |
| 1398738 | N/A | N/A | 103654 | 103673 | TTGGCAGGACTTATCACTCC | 40 | 1002 |
| 1398748 | N/A | N/A | 16371 | 16390 | ACTACAGGTTTTCCCCACAT | 56 | 1003 |
| 1398768 | N/A | N/A | 223648 | 223667 | GTGCAACTTTTCAAGCAAGG | 17 | 1004 |
| 1398780 | N/A | N/A | 167733 | 167752 | ATGTTGAATTTCTTACACTT | 47 | 1005 |
| 1398814 | N/A | N/A | 99771 | 99790 | CCCCCAAATTTTTCATGGCA | 63 | 1006 |
| 1398829 | N/A | N/A | 163587 | 163606 | GTGTATTTATCATATTTGCT | 20 | 1007 |
| 1398869 | N/A | N/A | 66494 | 66513 | TTGCACTCTTATCTTTCCCC | 36 | 1008 |
| 1398897 | N/A | N/A | 34545 | 34564 | ACTTGCACCAGACTCTACTC | 57 | 1009 |
| 1398922 | N/A | N/A | 275946 | 275965 | TGTGTCTTTTTCCATGTGCA | 11 | 1010 |
| 1398966 | N/A | N/A | 118307 | 118326 | GCTCAGTCATATTTGCAAAT | 37 | 1011 |
| 1398974 | N/A | N/A | 287613 | 287632 | GTTCAGGAACTCCTTTGCTA | 61 | 1012 |
| 1399006 | N/A | N/A | 159402 | 159421 | GCCTGAGAGACTCATCCCTC | 49 | 1013 |
| 1399038 | 281 | 300 | 83950 | 83969 | TTGGCTTCTACCACATTGGT | 23 | 1014 |
| 1399044 | N/A | N/A | 30262 | 30281 | CCCTGGTAACACCACCCTTC | 69 | 1015 |
| 1399056 | N/A | N/A | 24096 | 24115 | GCTTCTTCCAACACCCCAGC | 42 | 1016 |
| 1399081 | N/A | N/A | 241296 | 241315 | GTTAGCCTTTCCTTATCTGT | 41 | 1017 |
| 1399116 | N/A | N/A | 31797 | 31816 | TATCCACTGGACCTTCCCTA | 77 | 1018 |
| 1399177 | N/A | N/A | 10465 | 10484 | CTGCTCATGAACCCTCCACT | 67 | 1019 |
| 1399189 | N/A | N/A | 48384 | 48403 | CTAGAGTGCTTTCATGGCCA | 53 | 1020 |
| 1399270 | N/A | N/A | 174503 | 174522 | GCTCAATTCAATCACATTCC | 31 | 1021 |
| 1399293 | N/A | N/A | 25226 | 25245 | TCCCTCATTCATCCAGGGCC | 47 | 1022 |
| 1399314 | N/A | N/A | 90450 | 90469 | GTATTTCTCAACTTTGTAC | 29 | 1023 |
| 1399344 | N/A | N/A | 59981 | 60000 | CCCACAGTACTTTATTCTGT | 61 | 1024 |
| 1399362 | N/A | N/A | 12590 | 12609 | CGTAGCATTCTCTTATATTC | 30 | 1025 |
| 1399376 | N/A | N/A | 213987 | 214006 | GCTACTATACCTCACAGCCC | 76 | 1026 |
| 1399394 | N/A | N/A | 85706 | 85725 | GTGGATTTCATCTTTCCATC | 27 | 1027 |
| 1399404 | N/A | N/A | 15583 | 15602 | GCCACTCAATATCCTACCTC | 18 | 1028 |
| 1399406 | N/A | N/A | 47285 | 47304 | GCTGTAGGCCCTCCCCCACC | 59 | 1029 |
| 1399417 | N/A | N/A | 13867 | 13886 | ACATGGCTACTCTATCATCA | 54 | 1030 |

TABLE 13-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1399423 | N/A | N/A | 36993 | 37012 | TCAAGAGATCCATCTCTGCT | 65 | 1031 |
| 1399444 | N/A | N/A | 199259 | 199278 | GGAAGACATCCTTCCAGCTT | 94 | 1032 |
| 1399454 | N/A | N/A | 20347 | 20366 | CCTACAAGCCATGAATCCTC | 63 | 1033 |
| 1399463 | N/A | N/A | 104991 | 105010 | GGACAATGACTAATTCCTCA | 55 | 1034 |
| 1399472 | N/A | N/A | 154890 | 154909 | CCTTGTTCACCTGTTACCTC | 47 | 1035 |
| 1399493 | N/A | N/A | 28312 | 28331 | CTACCTTCTCCTCCATTCCA | 66 | 1036 |

TABLE 14

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 16 | 178 |
| 1394455 | 1152 | 1171 | 191551 | 191570 | GAGATACTTGTCAACGGCAT | 53 | 1037 |
| 1394558 | 492 | 511 | N/A | N/A | ACTGCATGTCTCTTTGGCGA | 32 | 1038 |
| 1397531 | N/A | N/A | 50556 | 50575 | GCCAAGATTACTTCTTTTCC | 31 | 1039 |
| 1397535 | N/A | N/A | 52344 | 52363 | GGCCTTACAGATCCTCATCT | 65 | 1040 |
| 1397538 | N/A | N/A | 80447 | 80466 | TCTTCAGATTCCTATGGTAA | 82 | 1041 |
| 1397556 | N/A | N/A | 97658 | 97677 | CTATGCTCACAACAACCCCT | 76 | 1042 |
| 1397562 | N/A | N/A | 15584 | 15603 | TGCCACTCAATATCCTACCT | 28 | 1043 |
| 1397583 | N/A | N/A | 187840 | 187859 | GTCCTCACCCATCAAGGTAC | 49 | 1044 |
| 1397584 | N/A | N/A | 183303 | 183322 | AGCTGATTTCATTTTACCCC | 26 | 1045 |
| 1397595 | N/A | N/A | 220506 | 220525 | GGTACATCCATCTACAACAT | 38 | 1046 |
| 1397641 | N/A | N/A | 163735 | 163754 | GCAGTTTACCTCCATATCTC | 28 | 1047 |
| 1397682 | 285 | 304 | 83954 | 83973 | TTGGTTGGCTTCTACCACAT | 23 | 1048 |
| 1397713 | N/A | N/A | 10209 | 10228 | ATCACCAGTTTCATACACTC | 41 | 1049 |
| 1397729 | N/A | N/A | 267126 | 267145 | GAGCACATACATCAATAGTT | 80 | 1050 |
| 1397751 | N/A | N/A | 283850 | 283869 | ACACTCTGATCTATGGGTCA | 51 | 1051 |
| 1397761 | N/A | N/A | 38854 | 38873 | TCCCTTCTTACAATTATGCT | 75 | 1052 |
| 1397768 | N/A | N/A | 104415 | 104434 | TGCCCAGGCTCATTTGGTCC | 65 | 1053 |
| 1397836 | N/A | N/A | 28315 | 28334 | GTACTACCTTCTCCTCCATT | 68 | 1054 |
| 1397843 | N/A | N/A | 7476 | 7495 | CCTCTGTTCAACTCATCGGA | 37 | 1055 |
| 1397849 | N/A | N/A | 118328 | 118347 | CCCACCTCATCTGTCAGCTC | 72 | 1056 |
| 1397888 | N/A | N/A | 16382 | 16401 | GCCTACTCAGAACTACAGGT | 38 | 1057 |
| 1398002 | N/A | N/A | 41607 | 41626 | ACCCATTAGACATTTCAGCA | 25 | 1058 |
| 1398025 | N/A | N/A | 45401 | 45420 | ATGCCTCATTTCATATCTAA | 62 | 1059 |

TABLE 14-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398078 | N/A | N/A | 140359 | 140378 | TGGACCATCATCTAGATGCA | 78 | 1060 |
| 1398081 | N/A | N/A | 287634 | 287653 | ATCAAGCAATTCTTCAGGCA | 45 | 1061 |
| 1398157 | N/A | N/A | 281614 | 281633 | GCAGATGTCCTAATTTCCTT | 49 | 1062 |
| 1398209 | N/A | N/A | 131575 | 131594 | GACAAGTTTTCACTAACTAC | 43 | 1063 |
| 1398227 | N/A | N/A | 34556 | 34575 | CTCCAATTTTAACTTGCACC | 9 | 1064 |
| 1398254 | N/A | N/A | 47429 | 47448 | TGAGCCCTATGAACTGTTTC | 49 | 1065 |
| 1398290 | N/A | N/A | 66495 | 66514 | CTTGCACTCTTATCTTTCCC | 42 | 1066 |
| 1398324 | N/A | N/A | 55029 | 55048 | TTGCCATATCTCATCAGCCT | 70 | 1067 |
| 1398363 | N/A | N/A | 25504 | 25523 | TGAGGCTCATTTCAAACTCT | 46 | 1068 |
| 1398421 | N/A | N/A | 59991 | 60010 | CGCCATTGTTCCCACAGTAC | 60 | 1069 |
| 1398440 | N/A | N/A | 90844 | 90863 | GCATATATTTTATTACACCA | 14 | 1070 |
| 1398465 | N/A | N/A | 223649 | 223668 | GGTGCAACTTTTCAAGCAAG | 30 | 1071 |
| 1398493 | N/A | N/A | 229317 | 229336 | TGGATTCATCTCCATACTCA | 33 | 1072 |
| 1398534 | N/A | N/A | 175045 | 175064 | ACTTCATATTTTTATCCCCC | 50 | 1073 |
| 1398609 | N/A | N/A | 159445 | 159464 | GCACTTTCTCTTCTCCATGC | 29 | 1074 |
| 1398629 | N/A | N/A | 276309 | 276328 | CCTGTATTACATCATAATTA | 67 | 1075 |
| 1398703 | N/A | N/A | 13878 | 13897 | GCCAAATACTCACATGGCTA | 56 | 1076 |
| 1398716 | N/A | N/A | 107302 | 107321 | CTGCATCTCATCCTATAGAT | 91 | 1077 |
| 1398733 | N/A | N/A | 37132 | 37151 | CTAGAATGTCATTCTCCGCT | 82 | 1078 |
| 1398735 | N/A | N/A | 8269 | 8288 | AAGCTAAATCTCTATTGCAT | 51 | 1079 |
| 1398776 | N/A | N/A | 271935 | 271954 | CCACTGTTATTACAATGGTC | 64 | 1080 |
| 1398825 | N/A | N/A | 19482 | 19501 | GCCTGGTAACTCTATTCATC | 39 | 1081 |
| 1398849 | N/A | N/A | 154893 | 154912 | ACTCCTTGTTCACCTGTTAC | 45 | 1082 |
| 1398920 | 2436 | 2455 | 292420 | 292439 | AATCATAAAACGGGTTTGTT | 66 | 1083 |
| 1398921 | N/A | N/A | 10471 | 10490 | TCATCCCTGCTCATGAACCC | 77 | 1084 |
| 1398956 | N/A | N/A | 85707 | 85726 | TGTGGATTTCATCTTTCCAT | 33 | 1085 |
| 1398961 | N/A | N/A | 178593 | 178612 | ATTTCACTAACCGGCAAAAC | 81 | 1086 |
| 1398968 | N/A | N/A | 102173 | 102192 | GCTGTAGGATCTTCATTCTC | 31 | 1087 |
| 1399007 | N/A | N/A | 33400 | 33419 | TCCCTTCTCTAAATCAGGCC | 67 | 1088 |
| 1399023 | N/A | N/A | 99957 | 99976 | AGCTGATAAAGATACCATCC | 34 | 1089 |
| 1399026 | N/A | N/A | 105023 | 105042 | ACTGATTATCAAATTCCGGA | 21 | 1090 |
| 1399070 | N/A | N/A | 87501 | 87520 | GCATTTTCTCTCTTCAAGC | 15 | 1091 |
| 1399111 | N/A | N/A | 27294 | 27313 | TTCAGCGCACTATTCTCTCT | 68 | 1092 |
| 1399119 | N/A | N/A | 258531 | 258550 | GCTTCATAACACCAGCCTTC | 81 | 1093 |
| 1399185 | N/A | N/A | 122983 | 123002 | CCTCCCATCTGCATAGTCTG | 8† | 1094 |
| 1399190 | N/A | N/A | 92233 | 92252 | TCCTTAATGCTCATTACCCA | 51 | 1095 |

TABLE 14-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
| --- | --- | --- | --- | --- | --- | --- | --- |
| 1399193 | N/A | N/A | 208564 | 208583 | GCTTCATACATCCTCTAACT | 56 | 1096 |
| 1399195 | N/A | N/A | 24098 | 24117 | GTGCTTCTTCCAACACCCCA | 45 | 1097 |
| 1399255 | N/A | N/A | 88991 | 89010 | TTCATAGTCTATCTTTTGCT | 37 | 1098 |
| 1399295 | N/A | N/A | 154158 | 154177 | GCATCAGGCTAACAAGTTCA | 19 | 1099 |
| 1399301 | N/A | N/A | 241408 | 241427 | GCACAAGACCTCATCCAGGC | 28 | 1100 |
| 1399325 | N/A | N/A | 103737 | 103756 | CTCTCTGTTACCACGCCTCT | 66 | 1101 |
| 1399349 | N/A | N/A | 20363 | 20382 | GTACTTTTAACTCATTCCTA | 43 | 1102 |
| 1399371 | N/A | N/A | 31804 | 31823 | TGGTAAATATCCACTGGACC | 42 | 1103 |
| 1399372 | N/A | N/A | 48520 | 48539 | GCACAGCCAAGACTACGGTC | 64 | 1104 |
| 1399385 | N/A | N/A | 95446 | 95465 | TGTAAGCTACTCTTCTACCC | 69 | 1105 |
| 1399397 | N/A | N/A | 213989 | 214008 | GGGCTACTATACCTCACAGC | 80 | 1106 |
| 1399398 | N/A | N/A | 199260 | 199279 | TGGAAGACATCCTTCCAGCT | 72 | 1107 |
| 1399427 | N/A | N/A | 6030 | 6049 | TCGGCTTCTACCTTTAGCGA | 12 | 1108 |
| 1399470 | N/A | N/A | 167734 | 167753 | GATGTTGAATTTCTTACACT | 35 | 1109 |
| 1399479 | N/A | N/A | 22721 | 22740 | ACTTCATGCTCCCACTGAAT | 91 | 1110 |
| 1399495 | N/A | N/A | 30275 | 30294 | CCCCACATCCAAACCCTGGT | 85 | 1111 |
| 1399505 | 1781 | 1800 | 262098 | 262117 | CCGTAACTGATCCTTGGTTC | 47 | 1112 |
| 1399514 | N/A | N/A | 12616 | 12635 | TTGCATTCACAACACACATC | 44 | 1113 |

TABLE 15

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
| --- | --- | --- | --- | --- | --- | --- | --- |
| 1354057 | N/A | N/A | 158958 | 158977 | GCAGATATTTCAATATACAG | 27 | 178 |
| 1397529 | N/A | N/A | 183422 | 183441 | GCTCAACACTCAATAGATGA | 62 | 1114 |
| 1397567 | N/A | N/A | 19538 | 19557 | GACCCTACATCATCTCATAT | 61 | 1115 |
| 1397625 | N/A | N/A | 103738 | 103757 | TCTCTCTGTTACCACGCCTC | 69 | 1116 |
| 1397665 | N/A | N/A | 89001 | 89020 | ATGTACTGATTTCATAGTCT | 26 | 1117 |
| 1397670 | N/A | N/A | 27295 | 27314 | ATTCAGCGCACTATTCTCTC | 67 | 1118 |
| 1397714 | N/A | N/A | 140679 | 140698 | TTCCCACTCTGCTCCTCGCT | 80 | 1119 |
| 1397741 | N/A | N/A | 15586 | 15605 | GTTGCCACTCAATATCCTAC | 49 | 1120 |
| 1397754 | N/A | N/A | 163836 | 163855 | GCACAGATGCTAATCACCAT | 42 | 1121 |
| 1397765 | N/A | N/A | 220523 | 220542 | TCGGACTTACTGTAATGGGT | 24 | 1122 |
| 1397781 | N/A | N/A | 241566 | 241585 | TGGACTATTTCCCACCCGGC | 67 | 1123 |

TABLE 15-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1397791 | N/A | N/A | 13879 | 13898 | AGCCAAATACTCACATGGCT | 84 | 1124 |
| 1397828 | N/A | N/A | 199261 | 199280 | CTGGAAGACATCCTTCCAGC | 102 | 1125 |
| 1397842 | N/A | N/A | 86228 | 86247 | GGTCATTAACTTTACTATCA | 18 | 1126 |
| 1397892 | N/A | N/A | 105087 | 105106 | GCTGCATGCTTCCAATTGCA | 73 | 1127 |
| 1397895 | N/A | N/A | 97661 | 97680 | CTCCTATGCTCACAACAACC | 93 | 1128 |
| 1397904 | 1153 | 1172 | 191552 | 191571 | CGAGATACTTGTCAACGGCA | 41 | 1129 |
| 1397934 | N/A | N/A | 276312 | 276331 | GAACCTGTATTACATCATAA | 107 | 1130 |
| 1397967 | N/A | N/A | 122984 | 123003 | ACCTCCCATCTGCATAGTCT | 25† | 1131 |
| 1397985 | N/A | N/A | 87515 | 87534 | GCCACACATAACAAGCATTT | 44 | 1132 |
| 1397998 | N/A | N/A | 25571 | 25590 | AGTGTTTTTCTTCAGGGTT | 32 | 1133 |
| 1398024 | N/A | N/A | 223650 | 223669 | AGGTGCAACTTTTCAAGCAA | 51 | 1134 |
| 1398042 | N/A | N/A | 61088 | 61107 | GCAGGCAATAGACCACTTCA | 71 | 1135 |
| 1398080 | N/A | N/A | 47467 | 47486 | GCTTGTTAACTACATGGGTC | 66 | 1136 |
| 1398085 | N/A | N/A | 52612 | 52631 | TGGCAGTTATACACAGATCC | 60 | 1137 |
| 1398098 | N/A | N/A | 10488 | 10507 | TTTGTCCTATTTATTCCTCA | 55 | 1138 |
| 1398115 | N/A | N/A | 118329 | 118348 | GCCCACCTCATCTGTCAGCT | 72 | 1139 |
| 1398140 | N/A | N/A | 84110 | 84129 | GGAGCATCCTCTTTTTCTTC | 61 | 1140 |
| 1398146 | N/A | N/A | 92291 | 92310 | TGTGGAATACTATATTATCA | 36 | 1141 |
| 1398150 | N/A | N/A | 7555 | 7574 | TCTGAGCTCTCACTATGAAA | 59 | 1142 |
| 1398168 | N/A | N/A | 100458 | 100477 | AGGAACTTCTGACTACCATA | 80 | 1143 |
| 1398299 | N/A | N/A | 33411 | 33430 | CAGTGGTTTAATCCCTTCTC | 71 | 1144 |
| 1398307 | N/A | N/A | 213992 | 214011 | GTTGGGCTACTATACCTCAC | 65 | 1145 |
| 1398318 | N/A | N/A | 50557 | 50576 | AGCCAAGATTACTTCTTTTC | 54 | 1146 |
| 1398322 | N/A | N/A | 28316 | 28335 | TGTACTACCTTCTCCTCCAT | 87 | 1147 |
| 1398330 | 1857 | 1876 | 262174 | 262193 | GCTGAACTCTCCATTCACGG | 40 | 1148 |
| 1398350 | N/A | N/A | 66496 | 66515 | GCTTGCACTCTTATCTTTCC | 43 | 1149 |
| 1398358 | N/A | N/A | 131576 | 131595 | TGACAAGTTTTCACTAACTA | 71 | 1150 |
| 1398365 | N/A | N/A | 12645 | 12664 | AGAGAACTTTGACAATACTA | 45 | 1151 |
| 1398380 | N/A | N/A | 6108 | 6127 | TCATGGTTTCTCATCGATTA | 41 | 1152 |
| 1398476 | N/A | N/A | 22725 | 22744 | ACCCACTTCATGCTCCCACT | 55 | 1153 |
| 1398509 | N/A | N/A | 281695 | 281714 | GGTCAGCATTTTCCTAGTCA | 53 | 1154 |
| 1398555 | N/A | N/A | 8273 | 8292 | GTTCAAGCTAAATCTCTATT | 70 | 1155 |
| 1398561 | N/A | N/A | 55716 | 55735 | GTGGCATCTACTGCTAGGAC | 49 | 1156 |
| 1398567 | N/A | N/A | 20368 | 20387 | TCCTTGTACTTTTAACTCAT | 43 | 1157 |
| 1398601 | N/A | N/A | 159493 | 159512 | GCCAACTTCTCTGCAACATA | 28 | 1158 |
| 1398652 | N/A | N/A | 30290 | 30309 | ACATCGCCTCACTTCCCCCA | 57 | 1159 |

TABLE 15-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398658 | N/A | N/A | 80455 | 80474 | GCATACCATCTTCAGATTCC | 63 | 1160 |
| 1398751 | N/A | N/A | 229661 | 229680 | GCACACCAAGTCAACATTCC | 33 | 1161 |
| 1398764 | N/A | N/A | 41790 | 41809 | ACTCCAGCCTCACATAGGGA | 68 | 1162 |
| 1398777 | N/A | N/A | 267335 | 267354 | GTTTGGTTTTTCTATACTTC | 34 | 1163 |
| 1398782 | N/A | N/A | 10211 | 10230 | GTATCACCAGTTTCATACAC | 43 | 1164 |
| 1398838 | N/A | N/A | 37290 | 37309 | GAGCAACTTACAAGGCAGAC | 52 | 1165 |
| 1398839 | N/A | N/A | 283851 | 283870 | CACACTCTGATCTATGGGTC | 47 | 1166 |
| 1398852 | N/A | N/A | 188099 | 188118 | CAGCAAGCCAGATTACTGTC | 64 | 1167 |
| 1398862 | N/A | N/A | 24099 | 24118 | TGTGCTTCTTCCAACACCCC | 55 | 1168 |
| 1398888 | N/A | N/A | 258534 | 258553 | TGGGCTTCATAACACCAGCC | 64 | 1169 |
| 1398903 | N/A | N/A | 104451 | 104470 | TGCACATATCACCAACGACC | 79 | 1170 |
| 1398983 | N/A | N/A | 175126 | 175145 | ATGGAAGTCTCACATCTGGT | 46 | 1171 |
| 1399017 | N/A | N/A | 154923 | 154942 | ATCCTCTCATTGTACTGCAT | 34 | 1172 |
| 1399033 | N/A | N/A | 34557 | 34576 | TCTCCAATTTTAACTTGCAC | 40 | 1173 |
| 1399060 | N/A | N/A | 102231 | 102250 | GTGATTTACCATTTTCAGGC | 31 | 1174 |
| 1399062 | N/A | N/A | 31805 | 31824 | TTGGTAAATATCCACTGGAC | 64 | 1175 |
| 1399082 | 2438 | 2457 | 292422 | 292441 | TAAATCATAAAACGGGTTTG | 74 | 1176 |
| 1399106 | N/A | N/A | 208565 | 208584 | TGCTTCATACATCCTCTAAC | 61 | 1177 |
| 1399176 | N/A | N/A | 90845 | 90864 | CGCATATATTTTATTACACC | 27 | 1178 |
| 1399209 | N/A | N/A | 154175 | 154194 | GTCCTTCCCTGCTACAGGCA | 36 | 1179 |
| 1399229 | N/A | N/A | 272135 | 272154 | GGTTTCCCTTTATTTGGACT | 50 | 1180 |
| 1399252 | N/A | N/A | 178595 | 178614 | TGATTTCACTAACCGGCAAA | 84 | 1181 |
| 1399316 | N/A | N/A | 167736 | 167755 | TTGATGTTGAATTTCTTACA | 46 | 1182 |
| 1399373 | 493 | 512 | N/A | N/A | CACTGCATGTCTCTTTGGCG | 35 | 1183 |
| 1399405 | N/A | N/A | 48756 | 48775 | GCAGCATCCCACCAGTGTAT | 88 | 1184 |
| 1399424 | N/A | N/A | 287691 | 287710 | GCCATCTCTCTATAGTTATA | 48 | 1185 |
| 1399440 | N/A | N/A | 108219 | 108238 | TTGCCTCTTTTTGACTGCAC | 53 | 1186 |
| 1399450 | N/A | N/A | 95447 | 95466 | ATGTAAGCTACTCTTCTACC | 67 | 1187 |
| 1399458 | N/A | N/A | 38855 | 38874 | TTCCCTTCTTACAATTATGC | 65 | 1188 |
| 1399484 | N/A | N/A | 16618 | 16637 | CCGGCCTTTTTGATTACTCT | 76 | 1189 |
| 1399509 | N/A | N/A | 45498 | 45517 | GCATGCTTATACCACTAAGT | 47 | 1190 |

TABLE 16

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 11 | 178 |
| 1396905 | N/A | N/A | 66497 | 66516 | TGCTTGCACTCTTATCTTTC | 43 | 1191 |
| 1397650 | N/A | N/A | 103991 | 104010 | GCTATGAGTTCACAAAGCTC | 40 | 1192 |
| 1397698 | N/A | N/A | 50716 | 50735 | GTGGTTTTATTACTAGGATT | 31 | 1193 |
| 1397717 | N/A | N/A | 80456 | 80475 | TGCATACCATCTTCAGATTC | 68 | 1194 |
| 1397731 | N/A | N/A | 33440 | 33459 | TGCTGGCCCAAATTCCATCC | 33 | 1195 |
| 1397752 | N/A | N/A | 100904 | 100923 | CAGGAATCATCAATGCAGGC | 51 | 1196 |
| 1397773 | N/A | N/A | 159495 | 159514 | ACGCCAACTTCTCTGCAACA | 41 | 1197 |
| 1397820 | N/A | N/A | 22807 | 22826 | TTCACCACATAACATCAGGA | 54 | 1198 |
| 1397864 | N/A | N/A | 7573 | 7592 | CCACTCCATACATTTGCATC | 67 | 1199 |
| 1397878 | N/A | N/A | 154927 | 154946 | TGGCATCCTCTCATTGTACT | 18 | 1200 |
| 1397898 | N/A | N/A | 34559 | 34578 | GTTCTCCAATTTTAACTTGC | 39 | 1201 |
| 1397947 | N/A | N/A | 84221 | 84240 | AATACTGCTCCTATAGGGTC | 48 | 1202 |
| 1397957 | 1859 | 1878 | 262176 | 262195 | AGGCTGAACTCTCCATTCAC | 76 | 1203 |
| 1397964 | N/A | N/A | 28317 | 28336 | ATGTACTACCTTCTCCTCCA | 70 | 1204 |
| 1397980 | N/A | N/A | 52628 | 52647 | TACCTCACACAACACCTGGC | 70 | 1205 |
| 1398000 | N/A | N/A | 31975 | 31994 | CCACACTATATACATAACCT | 78 | 1206 |
| 1398004 | N/A | N/A | 19541 | 19560 | CTGGACCCTACATCATCTCA | 56 | 1207 |
| 1398017 | N/A | N/A | 87560 | 87579 | CCACACTGGATCCTTCATCT | 55 | 1208 |
| 1398039 | N/A | N/A | 98136 | 98155 | CACAAACTACTTTCCCTGGA | 99 | 1209 |
| 1398084 | N/A | N/A | 37318 | 37337 | GCTGATTACTTCCTTGTATC | 37 | 1210 |
| 1398086 | N/A | N/A | 27297 | 27316 | GCATTCAGCGCACTATTCTC | 49 | 1211 |
| 1398087 | N/A | N/A | 231031 | 231050 | TCCACAGTCCCTCATCCTCT | 53 | 1212 |
| 1398089 | N/A | N/A | 178596 | 178615 | GTGATTTCACTAACCGGCAA | 44 | 1213 |
| 1398094 | N/A | N/A | 105114 | 105133 | CCTTTCACTTAGCATTCCCA | 48 | 1214 |
| 1398113 | N/A | N/A | 276314 | 276333 | CAGAACCTGTATTACATCAT | 83 | 1215 |
| 1398135 | N/A | N/A | 13880 | 13899 | CAGCCAAATACTCACATGGC | 44 | 1216 |
| 1398144 | N/A | N/A | 45500 | 45519 | TTGCATGCTTATACCACTAA | 53 | 1217 |
| 1398166 | N/A | N/A | 183620 | 183639 | ACATCTATTCTCTATTCAGC | 38 | 1218 |
| 1398176 | N/A | N/A | 287693 | 287712 | ATGCCATCTCTCTATAGTTA | 33 | 1219 |
| 1398194 | N/A | N/A | 95691 | 95710 | GTACCTAATTCACAATAGTA | 41 | 1220 |
| 1398219 | N/A | N/A | 30294 | 30313 | ACCAACATCGCCTCACTTCC | 50 | 1221 |
| 1398244 | N/A | N/A | 61106 | 61125 | GTCCTAGCTATTACCATTGC | 68 | 1222 |
| 1398247 | N/A | N/A | 25715 | 25734 | GCAGCTACCTCCAGCTGGTC | 38 | 1223 |
| 1398249 | N/A | N/A | 122985 | 123004 | TACCTCCCATCTGCATAGTC | 33† | 1224 |
| 1398258 | N/A | N/A | 48782 | 48801 | GCTGCCACATTCCAAAGCAA | 87 | 1225 |

TABLE 16-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398306 | N/A | N/A | 214088 | 214107 | TCTCATTTAATACTGCCATT | 53 | 1226 |
| 1398311 | N/A | N/A | 223652 | 223671 | AAAGGTGCAACTTTTCAAGC | 39 | 1227 |
| 1398383 | N/A | N/A | 38868 | 38887 | GCAAGAGATATTATTCCCTT | 27 | 1228 |
| 1398499 | N/A | N/A | 55933 | 55952 | TGCCAACCTAATACCAAGCT | 87 | 1229 |
| 1398512 | N/A | N/A | 102328 | 102347 | GCTGTGTTTTAACCCAGAAC | 37 | 1230 |
| 1398530 | 2439 | 2458 | 292423 | 292442 | GTAAATCATAAAACGGGTTT | 71 | 1231 |
| 1398557 | N/A | N/A | 20379 | 20398 | GCCAGCCAATATCCTTGTAC | 47 | 1232 |
| 1398577 | N/A | N/A | 141044 | 141063 | GCATATTAACAATAATGGGC | 41 | 1233 |
| 1398584 | N/A | N/A | 199942 | 199961 | CGGTGAACACATCTATGCCT | 42 | 1234 |
| 1398642 | 494 | 513 | N/A | N/A | TCACTGCATGTCTCTTTGGC | 52 | 1235 |
| 1398674 | N/A | N/A | 10230 | 10249 | TCATCATCATTTAACCACAG | 40 | 1236 |
| 1398711 | N/A | N/A | 188118 | 188137 | ATCCTATATTCATACCAACC | 68 | 1237 |
| 1398727 | N/A | N/A | 15589 | 15608 | CCAGTTGCCACTCAATATCC | 43 | 1238 |
| 1398729 | N/A | N/A | 272136 | 272155 | TGGTTTCCCTTTATTTGGAC | 63 | 1239 |
| 1398752 | N/A | N/A | 6193 | 6212 | GCAGTACTAATAGCCTTGCA | 24 | 1240 |
| 1398756 | N/A | N/A | 104452 | 104471 | CTGCACATATCACCAACGAC | 79 | 1241 |
| 1398816 | N/A | N/A | 24100 | 24119 | ATGTGCTTCTTCCAACACCC | 43 | 1242 |
| 1398820 | N/A | N/A | 17274 | 17293 | GCAGACAATTTTTTTAGAAC | 46 | 1243 |
| 1398872 | N/A | N/A | 42114 | 42133 | GTCTACTTCCTACTGGAATC | 80 | 1244 |
| 1398899 | N/A | N/A | 131944 | 131963 | CCACTCTTACTTGACTCATC | 45 | 1245 |
| 1398943 | N/A | N/A | 89053 | 89072 | TTGACTTTTTTCTATTATCC | 50 | 1246 |
| 1398994 | N/A | N/A | 281985 | 282004 | TCAGTATATTCTCTGCCCAA | 45 | 1247 |
| 1399009 | 1154 | 1173 | 191553 | 191572 | TCGAGATACTTGTCAACGGC | 34 | 1248 |
| 1399035 | N/A | N/A | 12677 | 12696 | ATCTAAGTTTACCTTCACAT | 62 | 1249 |
| 1399041 | N/A | N/A | 208566 | 208585 | CTGCTTCATACATCCTCTAA | 63 | 1250 |
| 1399127 | N/A | N/A | 86358 | 86377 | TAGGCTTCTCTCCATTTCTC | 24 | 1251 |
| 1399159 | N/A | N/A | 119665 | 119684 | TTGCCATTATACCCCCACAA | 70 | 1252 |
| 1399160 | N/A | N/A | 220780 | 220799 | GGACACTGCACCTCCCTGAC | 67 | 1253 |
| 1399164 | N/A | N/A | 90846 | 90865 | GCGCATATATTTTATTACAC | 28 | 1254 |
| 1399220 | N/A | N/A | 175471 | 175490 | TTCCTCTTAGATCCTGGGCT | 56 | 1255 |
| 1399221 | N/A | N/A | 267918 | 267937 | GGCTTCTAACAATTTCAGCA | 31 | 1256 |
| 1399251 | N/A | N/A | 241772 | 241791 | GCAACTTCATCTTTTCCTGC | 25 | 1257 |
| 1399258 | N/A | N/A | 154268 | 154287 | ACCAAGGACTTTCAGTCCCA | 67 | 1258 |
| 1399317 | N/A | N/A | 167749 | 167768 | CCACAATCCTTTATTGATGT | 32 | 1259 |
| 1399330 | N/A | N/A | 108262 | 108281 | TTCCTCATTAACCAACCCAA | 80 | 1260 |
| 1399332 | N/A | N/A | 283858 | 283877 | ATGTGCTCACACTCTGATCT | 70 | 1261 |

TABLE 16-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1399392 | N/A | N/A | 258667 | 258686 | TCTCCTGTATGACTCTCCTC | 66 | 1262 |
| 1399435 | N/A | N/A | 8401 | 8420 | TGGCATCAAATTCAACATTA | 41 | 1263 |
| 1399446 | N/A | N/A | 10489 | 10508 | GTTTGTCCTATTTATTCCTC | 20 | 1264 |
| 1399476 | N/A | N/A | 163909 | 163928 | GCTTCTTGTCACAATCTCTA | 20 | 1265 |
| 1399510 | N/A | N/A | 92322 | 92341 | ACAGAATCTCTTTATTGTCA | 32 | 1266 |
| 1399512 | N/A | N/A | 47488 | 47507 | AGTGGTTCTCCAACAGGGTA | 35 | 1267 |

TABLE 17

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 46 | 178 |
| 1396899 | N/A | N/A | 199979 | 199998 | GTTCCTTCCATTCCAAGTAA | 62 | 1268 |
| 1397558 | N/A | N/A | 122987 | 123006 | CTTACCTCCCATCTGCATAG | 78† | 1269 |
| 1397561 | N/A | N/A | 98285 | 98304 | TGTACAGATATTTTTCTGGA | 98 | 1270 |
| 1397578 | N/A | N/A | 281986 | 282005 | TTCAGTATATTCTCTGCCCA | 78 | 1271 |
| 1397622 | N/A | N/A | 84269 | 84288 | TTTCAATATACACCCTGGGT | 89 | 1272 |
| 1397651 | N/A | N/A | 95780 | 95799 | TCCTTAATTTCATTTCAGTA | 90 | 1273 |
| 1397652 | N/A | N/A | 22816 | 22835 | GACTTGTTTTTCACCACATA | 43 | 1274 |
| 1397689 | N/A | N/A | 47520 | 47539 | ACACTAGTCTCACCCATGTT | 97 | 1275 |
| 1397709 | N/A | N/A | 55993 | 56012 | TTGATGTTTTTCACGGCCTC | 76 | 1276 |
| 1397724 | N/A | N/A | 12694 | 12713 | AGTTCCTTCCCCCAGTTATC | 78 | 1277 |
| 1397757 | N/A | N/A | 220936 | 220955 | CTGAGTTGCTCCTTCTGAAC | 65 | 1278 |
| 1397770 | N/A | N/A | 6196 | 6215 | TCCGCAGTACTAATAGCCTT | 39 | 1279 |
| 1397774 | N/A | N/A | 223723 | 223742 | CAGCTCTTTTCTCCGTTCTC | 59 | 1280 |
| 1397800 | N/A | N/A | 175485 | 175504 | GCTTTTCCATTACATTCCTC | 71 | 1281 |
| 1397831 | N/A | N/A | 13928 | 13947 | GTTAAGGCCACCTCTGTCCA | 195 | 1282 |
| 1397841 | N/A | N/A | 169813 | 169832 | GCAGCAGCATAGACTTGGGT | 59 | 1283 |
| 1397861 | N/A | N/A | 214094 | 214113 | TGCTGATCTCATTTAATACT | 69 | 1284 |
| 1397899 | 2440 | 2459 | 292424 | 292443 | AGTAAATCATAAAACGGGTT | 50 | 1285 |
| 1397911 | N/A | N/A | 31976 | 31995 | GCCACACTATATACATAACC | 120 | 1286 |
| 1397930 | N/A | N/A | 104006 | 104025 | AGGCATTACAATATTGCTAT | 77 | 1287 |
| 1397978 | 495 | 514 | N/A | N/A | CTCACTGCATGTCTCTTTGG | 105 | 1288 |
| 1398055 | 1155 | 1174 | 191554 | 191573 | CTCGAGATACTTGTCAACGG | 103 | 1289 |
| 1398064 | N/A | N/A | 108463 | 108482 | TTCCAAATTTAACCTTGTCT | 82 | 1290 |

TABLE 17-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
| --- | --- | --- | --- | --- | --- | --- | --- |
| 1398070 | N/A | N/A | 10232 | 10251 | GTTCATCATCATTTAACCAC | 58 | 1291 |
| 1398093 | N/A | N/A | 87639 | 87658 | TGACATACTTTCCCCATGCA | 56 | 1292 |
| 1398130 | N/A | N/A | 10519 | 10538 | GGCTTATTCATCTTTTCCCT | 25 | 1293 |
| 1398175 | N/A | N/A | 154345 | 154364 | GTGCTCAAAATCTAATGTTT | 61 | 1294 |
| 1398223 | N/A | N/A | 243500 | 243519 | AGGATGATTTTCAACATCCA | 104 | 1295 |
| 1398269 | N/A | N/A | 178597 | 178616 | TGTGATTTCACTAACCGGCA | 85 | 1296 |
| 1398276 | N/A | N/A | 17472 | 17491 | GTATACATCTAACTGCCTGC | 75 | 1297 |
| 1398285 | N/A | N/A | 90968 | 90987 | GCGCTTTTACTCTATCAATA | 39 | 1298 |
| 1398294 | N/A | N/A | 19542 | 19561 | ACTGGACCCTACATCATCTC | 82 | 1299 |
| 1398295 | N/A | N/A | 154928 | 154947 | GTGGCATCCTCTCATTGTAC | 89 | 1300 |
| 1398361 | N/A | N/A | 27613 | 27632 | AGTCTTTGCCCATCAGGGTT | 36 | 1301 |
| 1398443 | N/A | N/A | 104468 | 104487 | GCACACACACTCATCACTGC | 99 | 1302 |
| 1398467 | N/A | N/A | 288073 | 288092 | AGGTCTCCTCCTATTGCCCC | 111 | 1303 |
| 1398502 | N/A | N/A | 80457 | 80476 | TTGCATACCATCTTCAGATT | 138 | 1304 |
| 1398565 | N/A | N/A | 86492 | 86511 | CCAACTTTTTGAATTATGTA | 35 | 1305 |
| 1398579 | N/A | N/A | 37319 | 37338 | TGCTGATTACTTCCTTGTAT | 52 | 1306 |
| 1398614 | 1864 | 1883 | 262181 | 262200 | CGTCCAGGCTGAACTCTCCA | 101 | 1307 |
| 1398643 | N/A | N/A | 119667 | 119686 | GCTTGCCATTATACCCCCAC | 84 | 1308 |
| 1398683 | N/A | N/A | 101035 | 101054 | GCCATTTTTTGATAAGGAAC | 51 | 1309 |
| 1398720 | N/A | N/A | 272137 | 272156 | CTGGTTTCCCTTTATTTGGA | 64 | 1310 |
| 1398792 | N/A | N/A | 131946 | 131965 | ATCCACTCTTACTTGACTCA | 50 | 1311 |
| 1398793 | N/A | N/A | 276321 | 276340 | GTCAACCCAGAACCTGTATT | 78 | 1312 |
| 1398794 | N/A | N/A | 183798 | 183817 | GGAGAACACTATCAATGCAT | 64 | 1313 |
| 1398795 | N/A | N/A | 102493 | 102512 | GCTCCCATTTTATATTTAAC | 95 | 1314 |
| 1398800 | N/A | N/A | 52631 | 52650 | TGGTACCTCACACAACACCT | 108 | 1315 |
| 1398835 | N/A | N/A | 50737 | 50756 | GCTTATAACTCTCATACTGT | 52 | 1316 |
| 1398873 | N/A | N/A | 8402 | 8421 | CTGGCATCAAATTCAACATT | 47 | 1317 |
| 1398923 | N/A | N/A | 45501 | 45520 | ATTGCATGCTTATACCACTA | 91 | 1318 |
| 1398924 | N/A | N/A | 258770 | 258789 | GCATACCCATTCTGACACTT | 55 | 1319 |
| 1398930 | N/A | N/A | 141519 | 141538 | TGGGTTTCATTCTCAGTGCT | 96 | 1320 |
| 1398936 | N/A | N/A | 15620 | 15639 | TGGTACTGTATTTCTTCTAC | 78 | 1321 |
| 1398995 | N/A | N/A | 188732 | 188751 | TGGTAATTAATTTTCTGTGC | 78 | 1322 |
| 1399008 | N/A | N/A | 28484 | 28503 | ACTGGCTCACCTGCCTGCCA | 111 | 1323 |
| 1399039 | N/A | N/A | 38900 | 38919 | CCTGTCCTCACACTATTCTT | 128 | 1324 |
| 1399064 | N/A | N/A | 268126 | 268145 | ATACTTCCTTGTTTTACGCT | 45 | 1325 |
| 1399085 | N/A | N/A | 61195 | 61214 | GCTGGTGTCTCCTCTCCCAA | 70 | 1326 |

TABLE 17-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1399092 | N/A | N/A | 92764 | 92783 | CCCACATCTTCTTCTCATTC | 77 | 1327 |
| 1399134 | N/A | N/A | 105118 | 105137 | CTGACCTTTCACTTAGCATT | 122 | 1328 |
| 1399146 | N/A | N/A | 284033 | 284052 | AAGACATCTTTATTTGCTCA | 101 | 1329 |
| 1399171 | N/A | N/A | 34561 | 34580 | TGGTTCTCCAATTTTAACTT | 56 | 1330 |
| 1399214 | N/A | N/A | 20381 | 20400 | ATGCCAGCCAATATCCTTGT | 118 | 1331 |
| 1399228 | N/A | N/A | 208567 | 208586 | CCTGCTTCATACATCCTCTA | 82 | 1332 |
| 1399244 | N/A | N/A | 231103 | 231122 | GGCCATCCATCTTCCCCACT | 135 | 1333 |
| 1399254 | N/A | N/A | 42117 | 42136 | TCTGTCTACTTCCTACTGGA | 112 | 1334 |
| 1399273 | N/A | N/A | 26553 | 26572 | GCTGCCCTTTATATAAGCTT | 63 | 1335 |
| 1399289 | N/A | N/A | 66498 | 66517 | ATGCTTGCACTCTTATCTTT | 186 | 1336 |
| 1399300 | N/A | N/A | 89073 | 89092 | TGTGTCGACTTTCAAGTCTT | 38 | 1337 |
| 1399307 | N/A | N/A | 33493 | 33512 | TTGTAGGATTTTCTTGGCAC | 95 | 1338 |
| 1399328 | N/A | N/A | 163938 | 163957 | CTGACATGTACACCTCTCCA | 81 | 1339 |
| 1399351 | N/A | N/A | 159544 | 159563 | GGTGCTCTATCACCCAGTAA | 53 | 1340 |
| 1399352 | N/A | N/A | 30295 | 30314 | GACCAACATCGCCTCACTTC | 73 | 1341 |
| 1399409 | N/A | N/A | 49225 | 49244 | CCGTTCCCACTCTACACAGA | 54 | 1342 |
| 1399459 | N/A | N/A | 7574 | 7593 | CCCACTCCATACATTTGCAT | 53 | 1343 |
| 1399488 | N/A | N/A | 24102 | 24121 | TCATGTGCTTCTTCCAACAC | 79 | 1344 |

TABLE 18

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 17 | 178 |
| 1397527 | N/A | N/A | 13929 | 13948 | TGTTAAGGCCACCTCTGTCC | 72 | 1345 |
| 1397544 | N/A | N/A | 125364 | 125383 | GTGCAAGACATACCAGACAC | 44 | 1346 |
| 1397554 | N/A | N/A | 119668 | 119687 | TGCTTGCCATTATACCCCCA | 59 | 1347 |
| 1397624 | N/A | N/A | 28753 | 28772 | AGGCAGTGATCTCTAACCTT | 60 | 1348 |
| 1397631 | N/A | N/A | 102856 | 102875 | CGGCAGTTTAAAATTCTCTT | 22 | 1349 |
| 1397635 | N/A | N/A | 220972 | 220991 | TCCACCTCCACTATCTTCAT | 69 | 1350 |
| 1397649 | N/A | N/A | 31977 | 31996 | AGCCACACTATATACATAAC | 81 | 1351 |
| 1397683 | N/A | N/A | 95922 | 95941 | CCATGATGCTTATTTGTGTA | 36 | 1352 |
| 1397695 | N/A | N/A | 20393 | 20412 | GCGACAGTCACCATGCCAGC | 50 | 1353 |
| 1397723 | N/A | N/A | 132173 | 132192 | GTCCAAGTTTATTCAATACA | 37 | 1354 |

TABLE 18-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1397740 | N/A | N/A | 104007 | 104026 | CAGGCATTACAATATTGCTA | 53 | 1355 |
| 1397853 | N/A | N/A | 176134 | 176153 | CCTTCTTCATACATTATTCT | 53 | 1356 |
| 1397918 | N/A | N/A | 208568 | 208587 | TCCTGCTTCATACATCCTCT | 48 | 1357 |
| 1397923 | N/A | N/A | 10521 | 10540 | CAGGCTTATTCATCTTTTCC | 46 | 1358 |
| 1398020 | N/A | N/A | 243501 | 243520 | AAGGATGATTTTCAACATCC | 68 | 1359 |
| 1398026 | N/A | N/A | 38902 | 38921 | GCCCTGTCCTCACACTATTC | 61 | 1360 |
| 1398043 | N/A | N/A | 61307 | 61326 | CTGTAGAATTCACCATCCAC | 90 | 1361 |
| 1398145 | N/A | N/A | 284762 | 284781 | GGTTGATCCTAATCCACTAT | 47 | 1362 |
| 1398149 | N/A | N/A | 87640 | 87659 | CTGACATACTTTCCCCATGC | 46 | 1363 |
| 1398154 | N/A | N/A | 184111 | 184130 | GCAGAGCTTTCCGAGTGCCA | 64 | 1364 |
| 1398167 | N/A | N/A | 10276 | 10295 | CCCATGTGAATTCTTTGGGA | 56 | 1365 |
| 1398217 | N/A | N/A | 19546 | 19565 | GATCACTGGACCCTACATCA | 45 | 1366 |
| 1398255 | N/A | N/A | 22879 | 22898 | TACCGTCTCTTTTCTGGTCA | 63 | 1367 |
| 1398272 | N/A | N/A | 178599 | 178618 | AATGTGATTTCACTAACCGG | 37 | 1368 |
| 1398288 | N/A | N/A | 26554 | 26573 | TGCTGCCCTTTATATAAGCT | 54 | 1369 |
| 1398357 | N/A | N/A | 8420 | 8439 | ATTGGCCTAACATCACGCCT | 57 | 1370 |
| 1398364 | N/A | N/A | 56192 | 56211 | GCCACATCTATTCACAGCCA | 54 | 1371 |
| 1398394 | N/A | N/A | 201548 | 201567 | CCAGTATTTTTTACCCAGCA | 49 | 1372 |
| 1398396 | N/A | N/A | 92765 | 92784 | ACCCACATCTTCTTCTCATT | 56 | 1373 |
| 1398408 | 2113 | 2132 | 282147 | 282166 | CTTTGTTTGAACCCACATCT | 78 | 1374 |
| 1398419 | N/A | N/A | 24103 | 24122 | CTCATGTGCTTCTTCCAACA | 65 | 1375 |
| 1398434 | N/A | N/A | 80458 | 80477 | GTTGCATACCATCTTCAGAT | 70 | 1376 |
| 1398516 | N/A | N/A | 34617 | 34636 | GGTTATTTCTTCCAAAGCTC | 32 | 1377 |
| 1398543 | N/A | N/A | 104470 | 104489 | CAGCACACACACTCATCACT | 70 | 1378 |
| 1398551 | N/A | N/A | 30365 | 30384 | TCACTATTATTAACTAGTCA | 43 | 1379 |
| 1398556 | N/A | N/A | 154388 | 154407 | CATCCATTCCACATGGCCTA | 46 | 1380 |
| 1398563 | N/A | N/A | 50740 | 50759 | TGTGCTTATAACTCTCATAC | 49 | 1381 |
| 1398622 | N/A | N/A | 223724 | 223743 | CCAGCTCTTTTCTCCGTTCT | 47 | 1382 |
| 1398624 | N/A | N/A | 33531 | 33550 | CCGGAACTCTGTCTTGGGTA | 28 | 1383 |
| 1398628 | N/A | N/A | 105130 | 105149 | ACTCTTTCAATTCTGACCTT | 55 | 1384 |
| 1398637 | N/A | N/A | 42123 | 42142 | TGAATGTCTGTCTACTTCCT | 56 | 1385 |
| 1398657 | N/A | N/A | 27627 | 27646 | TGGCAAGCCTTTTTAGTCTT | 48 | 1386 |
| 1398663 | N/A | N/A | 262503 | 262522 | GTCTTTTCCAACAATTGGCA | 38 | 1387 |
| 1398706 | N/A | N/A | 170325 | 170344 | GCTACCTTGTCCAACTGGTT | 48 | 1388 |
| 1398818 | N/A | N/A | 49227 | 49246 | TGCCGTTCCCACTCTACACA | 112 | 1389 |
| 1398857 | N/A | N/A | 84317 | 84336 | TAGGCATTTTTCATTCAGGA | 41 | 1390 |

TABLE 18-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398876 | N/A | N/A | 159545 | 159564 | TGGTGCTCTATCACCCAGTA | 46 | 1391 |
| 1398881 | N/A | N/A | 52675 | 52694 | TCACTCCTCATACCTGCACA | 63 | 1392 |
| 1398973 | N/A | N/A | 259679 | 259698 | AGTCTCCTCACTGCTTGCTA | 61 | 1393 |
| 1398977 | N/A | N/A | 154929 | 154948 | TGTGGCATCCTCTCATTGTA | 61 | 1394 |
| 1398999 | N/A | N/A | 141806 | 141825 | CAACAAGCCCACTTTCTTGC | 57 | 1395 |
| 1399005 | N/A | N/A | 45556 | 45575 | GCCACAGTATTAAATTTGTT | 45 | 1396 |
| 1399011 | 497 | 516 | N/A | N/A | TTCTCACTGCATGTCTCTTT | 95 | 1397 |
| 1399042 | N/A | N/A | 98327 | 98346 | GCCTATTAATGACATGTGCA | 34 | 1398 |
| 1399091 | N/A | N/A | 164614 | 164633 | GCTTCGATACCTCTGCCTTA | 34 | 1399 |
| 1399093 | N/A | N/A | 101265 | 101284 | TCTGCATCAATAGCAGGGTT | 56 | 1400 |
| 1399099 | N/A | N/A | 15634 | 15653 | CCTCTATCCCTTTATGGTAC | 41 | 1401 |
| 1399103 | N/A | N/A | 6210 | 6229 | CATCTAGTAACTTCTCCGCA | 43 | 1402 |
| 1399109 | N/A | N/A | 47523 | 47542 | CTGACACTAGTCTCACCCAT | 86 | 1403 |
| 1399110 | N/A | N/A | 268167 | 268186 | CCATCATCTGACCTTTCCAA | 61 | 1404 |
| 1399183 | N/A | N/A | 89339 | 89358 | TCCCATTCTTCCTTCTGGCC | 82 | 1405 |
| 1399203 | 2442 | 2461 | 292426 | 292445 | TGAGTAAATCATAAAACGGG | 52 | 1406 |
| 1399205 | N/A | N/A | 276322 | 276341 | TGTCAACCCAGAACCTGTAT | 53 | 1407 |
| 1399219 | N/A | N/A | 12730 | 12749 | GTCTACAATTATTCTTTTAC | 58 | 1408 |
| 1399257 | N/A | N/A | 7575 | 7594 | CCCCACTCCATACATTTGCA | 53 | 1409 |
| 1399269 | N/A | N/A | 272173 | 272192 | CTTCATGACACCTCTTGCAT | 70 | 1410 |
| 1399285 | N/A | N/A | 288328 | 288347 | TGGCATGGCTTCAACTGGCT | 45 | 1411 |
| 1399309 | N/A | N/A | 17475 | 17494 | AAGGTATACATCTAACTGCC | 25 | 1412 |
| 1399322 | N/A | N/A | 231104 | 231123 | CGGCCATCCATCTTCCCCAC | 52 | 1413 |
| 1399327 | 1156 | 1175 | 191555 | 191574 | TCTCGAGATACTTGTCAACG | 70 | 1414 |
| 1399378 | N/A | N/A | 37320 | 37339 | GTGCTGATTACTTCCTTGTA | 51 | 1415 |
| 1399402 | N/A | N/A | 189271 | 189290 | GTCATCTTCTCATCTTAACT | 47 | 1416 |
| 1399403 | N/A | N/A | 66499 | 66518 | CATGCTTGCACTCTTATCTT | 56 | 1417 |
| 1399455 | N/A | N/A | 86552 | 86571 | GCTCATTTCACATCAGACAC | 28 | 1418 |
| 1399467 | N/A | N/A | 109510 | 109529 | GCCAAACTCCTACTGACTGC | 54 | 1419 |
| 1399468 | N/A | N/A | 91193 | 91212 | CCACATTTCACCCACCTCCA | 131 | 1420 |
| 1399492 | N/A | N/A | 214956 | 214975 | TTAGTCTCACTGTCTTGGCT | 94 | 1421 |

TABLE 19

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 19 | 178 |
| 1397533 | 1157 | 1176 | 191556 | 191575 | GTCTCGAGATACTTGTCAAC | 54 | 1422 |
| 1397541 | N/A | N/A | 30624 | 30643 | TTGGCTTTACCATAGAGCTA | 18 | 1423 |
| 1397564 | N/A | N/A | 34618 | 34637 | GGGTTATTTCTTCCAAAGCT | 36 | 1424 |
| 1397701 | N/A | N/A | 231791 | 231810 | GGACATTTCTTCTATCTACC | 44 | 1425 |
| 1397747 | N/A | N/A | 221288 | 221307 | GCCACTTCAACTGAAGTCAC | 35 | 1426 |
| 1397775 | N/A | N/A | 45572 | 45591 | TTGGTTCATTTCTTTAGCCA | 29 | 1427 |
| 1397779 | N/A | N/A | 164616 | 164635 | CAGCTTCGATACCTCTGCCT | 49 | 1428 |
| 1397813 | N/A | N/A | 92774 | 92793 | TGTTTCTTTACCCACATCTT | 46 | 1429 |
| 1397815 | 2115 | 2134 | 282149 | 282168 | ACCTTTGTTTGAACCCACAT | 70 | 1430 |
| 1397818 | N/A | N/A | 12736 | 12755 | TCTTCTGTCTACAATTATTC | 83 | 1431 |
| 1397935 | N/A | N/A | 104473 | 104492 | CCTCAGCACACACACTCATC | 96 | 1432 |
| 1397943 | N/A | N/A | 272177 | 272196 | TGTCCTTCATGACACCTCTT | 70 | 1433 |
| 1397968 | N/A | N/A | 184355 | 184374 | GGGTTAGTCTCCTTTCATCA | 62 | 1434 |
| 1398014 | N/A | N/A | 50741 | 50760 | GTGTGCTTATAACTCTCATA | 50 | 1435 |
| 1398028 | N/A | N/A | 66500 | 66519 | TCATGCTTGCACTCTTATCT | 63 | 1436 |
| 1398054 | N/A | N/A | 6226 | 6245 | AGGACCAGTATTATTCCATC | 36 | 1437 |
| 1398074 | N/A | N/A | 203120 | 203139 | GTGCACTGTAACTTTATCCA | 50 | 1438 |
| 1398075 | N/A | N/A | 10350 | 10369 | TGTGAACCCACTTCTTGTCT | 53 | 1439 |
| 1398186 | N/A | N/A | 98454 | 98473 | CAGTTTTTTCCCCAATCCAA | 54 | 1440 |
| 1398189 | N/A | N/A | 101365 | 101384 | CTAGTTGTTATTTACCGGCA | 39 | 1441 |
| 1398193 | N/A | N/A | 112138 | 112157 | CTCCAACTTTTCCAAGTGCA | 59 | 1442 |
| 1398207 | N/A | N/A | 159554 | 159573 | CATTCTATTTGGTGCTCTAT | 57 | 1443 |
| 1398220 | N/A | N/A | 47531 | 47550 | CCTTTACCCTGACACTAGTC | 63 | 1444 |
| 1398230 | N/A | N/A | 119670 | 119689 | CTTGCTTGCCATTATACCCC | 94 | 1445 |
| 1398253 | N/A | N/A | 170578 | 170597 | TGGCACTCTTGACTTTGAAC | 53 | 1446 |
| 1398265 | N/A | N/A | 10556 | 10575 | GCACTTCATTCATCAGGATC | 37 | 1447 |
| 1398315 | N/A | N/A | 24104 | 24123 | GCTCATGTGCTTCTTCCAAC | 33 | 1448 |
| 1398319 | N/A | N/A | 37365 | 37384 | GTCCACCTCATCTTTTTCTT | 52 | 1449 |
| 1398321 | N/A | N/A | 104008 | 104027 | CCAGGCATTACAATATTGCT | 94 | 1450 |
| 1398338 | N/A | N/A | 49228 | 49247 | ATGCCGTTCCCACTCTACAC | 99 | 1451 |
| 1398345 | N/A | N/A | 91194 | 91213 | CCCACATTTCACCCACCTCC | 84 | 1452 |
| 1398355 | N/A | N/A | 89894 | 89913 | CCTCAACTCATCCTCTGTCC | 69 | 1453 |
| 1398397 | N/A | N/A | 22880 | 22899 | ATACCGTCTCTTTTCTGGTC | 37 | 1454 |
| 1398403 | N/A | N/A | 7580 | 7599 | TCCATCCCCACTCCATACAT | 68 | 1455 |
| 1398407 | N/A | N/A | 80461 | 80480 | TTGGTTGCATACCATCTTCA | 63 | 1456 |

TABLE 19-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398428 | N/A | N/A | 126835 | 126854 | ACCTCTTTTTCAATGAGGTC | 78 | 1457 |
| 1398466 | N/A | N/A | 52677 | 52696 | GGTCACTCCTCATACCTGCA | 64 | 1458 |
| 1398470 | N/A | N/A | 95953 | 95972 | TGTAGATTCATCTTTATGTC | 64 | 1459 |
| 1398508 | N/A | N/A | 31981 | 32000 | GCCTAGCCACACTATATACA | 53 | 1460 |
| 1398529 | N/A | N/A | 42258 | 42277 | CCAACTGTTCTCATCAGTGA | 59 | 1461 |
| 1398562 | N/A | N/A | 86553 | 86572 | TGCTCATTTCACATCAGACA | 51 | 1462 |
| 1398568 | N/A | N/A | 87645 | 87664 | GCAACCTGACATACTTTCCC | 49 | 1463 |
| 1398580 | N/A | N/A | 208569 | 208588 | GTCCTGCTTCATACATCCTC | 57 | 1464 |
| 1398612 | N/A | N/A | 102857 | 102876 | TCGGCAGTTTAAAATTCTCT | 36 | 1465 |
| 1398625 | N/A | N/A | 27628 | 27647 | CTGGCAAGCCTTTTTAGTCT | 56 | 1466 |
| 1398646 | N/A | N/A | 284837 | 284856 | CTGCCAGTACCTCCACCTGT | 92 | 1467 |
| 1398650 | N/A | N/A | 105133 | 105152 | TCCACTCTTTCAATTCTGAC | 74 | 1468 |
| 1398655 | N/A | N/A | 223725 | 223744 | GCCAGCTCTTTTCTCCGTTC | 33 | 1469 |
| 1398736 | N/A | N/A | 13967 | 13986 | CCTGGACAGCTCTAATGGCC | 69 | 1470 |
| 1398739 | N/A | N/A | 17508 | 17527 | GTGCCAACCTTTTCAGTTCA | 31 | 1471 |
| 1398743 | N/A | N/A | 8465 | 8484 | GCTGCCTTCTCTACATACCT | 38 | 1472 |
| 1398809 | N/A | N/A | 176161 | 176180 | ACCCATCTAACTGATCTTCA | 82 | 1473 |
| 1398810 | N/A | N/A | 262527 | 262546 | TGCCACCTATACAATGGAGT | 36 | 1474 |
| 1398817 | N/A | N/A | 26639 | 26658 | GTTAAAGAATTCTTCTCTCA | 57 | 1475 |
| 1398865 | N/A | N/A | 141813 | 141832 | CCTCTTCCAACAAGCCCACT | 87 | 1476 |
| 1398868 | N/A | N/A | 259683 | 259702 | CGATAGTCTCCTCACTGCTT | 64 | 1477 |
| 1398893 | N/A | N/A | 19610 | 19629 | CCTGGGTCCCAAAAGGTCCC | 58 | 1478 |
| 1398941 | N/A | N/A | 15643 | 15662 | ACCCATTTTCCTCTATCCCT | 64 | 1479 |
| 1398964 | N/A | N/A | 288387 | 288406 | CTTCATGTGACTCTCGGTAC | 63 | 1480 |
| 1398967 | N/A | N/A | 33567 | 33586 | GCCAACTTCTAAGCTAACAA | 44 | 1481 |
| 1398993 | N/A | N/A | 84432 | 84451 | GCTTCACATTAGATTCTTTC | 66 | 1482 |
| 1399046 | N/A | N/A | 154984 | 155003 | GAGACCAATTTATCTCAAGC | 34 | 1483 |
| 1399059 | N/A | N/A | 268168 | 268187 | ACCATCATCTGACCTTTCCA | 63 | 1484 |
| 1399108 | N/A | N/A | 178600 | 178619 | AAATGTGATTTCACTAACCG | 61 | 1485 |
| 1399161 | N/A | N/A | 154389 | 154408 | TCATCCATTCCACATGGCCT | 57 | 1486 |
| 1399179 | N/A | N/A | 61649 | 61668 | GGCAATGCTTTCTTTTATAC | 69 | 1487 |
| 1399231 | N/A | N/A | 56527 | 56546 | TGCTCATTTCATCACTAACA | 50 | 1488 |
| 1399290 | N/A | N/A | 29341 | 29360 | TCTTGAACAACTTTCTGGGT | 61 | 1489 |
| 1399305 | N/A | N/A | 276323 | 276342 | TTGTCAACCCAGAACCTGTA | 76 | 1490 |
| 1399338 | N/A | N/A | 132561 | 132580 | TCCTACTATTTTTAAGCCAG | 40 | 1491 |
| 1399358 | N/A | N/A | 38919 | 38938 | TCTTCATGTTTTTAAGAGCC | 62 | 1492 |

TABLE 19-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1399374 | N/A | N/A | 21102 | 21121 | GCAGAACCAACCTAAGTGGC | 46 | 1493 |
| 1399425 | N/A | N/A | 243850 | 243869 | ACAGCATTGCCATAACAGCT | 83 | 1494 |
| 1399426 | 505 | 524 | 122810 | 122829 | TGGTACTCTTCTCACTGCAT | 48 | 1495 |
| 1399437 | 2443 | 2462 | 292427 | 292446 | ATGAGTAAATCATAAAACGG | 71 | 1496 |
| 1399460 | N/A | N/A | 215018 | 215037 | CATAGGCTACATCCCTGGCC | 83 | 1497 |
| 1399489 | N/A | N/A | 189272 | 189291 | AGTCATCTTCTCATCTTAAC | 65 | 1498 |

TABLE 20

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 21 | 178 |
| 1396904 | 2008 | 2027 | 276338 | 276357 | CCTCCGTCTTGATATTTGTC | 108 | 1499 |
| 1397591 | N/A | N/A | 12761 | 12780 | TCAACATTTAATCACCCAAA | 62 | 1500 |
| 1397606 | N/A | N/A | 52799 | 52818 | TGCTGCATAGACCTAGCCAA | 74 | 1501 |
| 1397613 | N/A | N/A | 26675 | 26694 | GCTCAGAATTCACTTGACAT | 66 | 1502 |
| 1397626 | N/A | N/A | 164643 | 164662 | TCTGTCCTATCTCAAGCAAC | 40 | 1503 |
| 1397663 | N/A | N/A | 42516 | 42535 | GGCTCTTTTTACTAAGCCAA | 78 | 1504 |
| 1397681 | N/A | N/A | 92776 | 92795 | GTTGTTTCTTTACCCACATC | 43 | 1505 |
| 1397700 | N/A | N/A | 24497 | 24516 | CAGTTATTTTTTCCAGACTA | 35 | 1506 |
| 1397737 | N/A | N/A | 34702 | 34721 | GTGTGCATACCTTAATCTCA | 34 | 1507 |
| 1397776 | N/A | N/A | 87697 | 87716 | CCAACTTATTCTCAAGGGAA | 31 | 1508 |
| 1397803 | N/A | N/A | 159556 | 159575 | TTCATTCTATTTGGTGCTCT | 47 | 1509 |
| 1397834 | N/A | N/A | 223726 | 223745 | TGCCAGCTCTTTTCTCCGTT | 36 | 1510 |
| 1397876 | N/A | N/A | 141814 | 141833 | TCCTCTTCCAACAAGCCCAC | 100 | 1511 |
| 1397912 | N/A | N/A | 105134 | 105153 | CTCCACTCTTTCAATTCTGA | 104 | 1512 |
| 1397954 | N/A | N/A | 126836 | 126855 | TACCTCTTTTTCAATGAGGT | 108 | 1513 |
| 1397969 | N/A | N/A | 10351 | 10370 | ATGTGAACCCACTTCTTGTC | 48 | 1514 |
| 1397975 | N/A | N/A | 272182 | 272201 | AGGTATGTCCTTCATGACAC | 50 | 1515 |
| 1398006 | N/A | N/A | 170606 | 170625 | TGGTTCTCCCAATCCTGTTA | 47 | 1516 |
| 1398048 | N/A | N/A | 155246 | 155265 | ATCTCTCAATGACCAGGTAT | 68 | 1517 |
| 1398097 | N/A | N/A | 13989 | 14008 | CCACAACATTCATTATGTTT | 45 | 1518 |
| 1398117 | N/A | N/A | 98499 | 98518 | TTGCAGGATACTACAGGCTA | 49 | 1519 |
| 1398136 | N/A | N/A | 50770 | 50789 | GTCATAACATTTACTCATCA | 36 | 1520 |
| 1398174 | N/A | N/A | 89895 | 89914 | TCCTCAACTCATCCTCTGTC | 59 | 1521 |

TABLE 20-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398236 | N/A | N/A | 56529 | 56548 | GTTGCTCATTTCATCACTAA | 68 | 1522 |
| 1398242 | N/A | N/A | 189277 | 189296 | GCTTTAGTCATCTTCTCATC | 62 | 1523 |
| 1398256 | 2154 | 2173 | 282188 | 282207 | CGCTATGACAACACCGCCCA | 70 | 1524 |
| 1398292 | N/A | N/A | 91195 | 91214 | GCCCACATTTCACCCACCTC | 68 | 1525 |
| 1398359 | N/A | N/A | 259743 | 259762 | GCTTTTCCACACCACCCTCA | 70 | 1526 |
| 1398459 | N/A | N/A | 96270 | 96289 | CCTGAGATTTCCCTTCACTA | 54 | 1527 |
| 1398471 | N/A | N/A | 6252 | 6271 | GCATGTTCCTTTTCATTTCC | 30 | 1528 |
| 1398504 | N/A | N/A | 31555 | 31574 | GCCAGACCATTTTAATACCA | 33 | 1529 |
| 1398511 | N/A | N/A | 19627 | 19646 | GGTTCAGAATCACATATCCT | 36 | 1530 |
| 1398539 | N/A | N/A | 28009 | 28028 | GCGCATTTATACAATATACT | 23 | 1531 |
| 1398627 | N/A | N/A | 33576 | 33595 | GCACACTGCGCCAACTTCTA | 80 | 1532 |
| 1398634 | N/A | N/A | 132720 | 132739 | GGGTTATTTTCCATGTCAC | 28 | 1533 |
| 1398667 | N/A | N/A | 112139 | 112158 | TCTCCAACTTTTCCAAGTGC | 59 | 1534 |
| 1398718 | N/A | N/A | 84437 | 84456 | CTGCAGCTTCACATTAGATT | 34 | 1535 |
| 1398765 | N/A | N/A | 7581 | 7600 | ATCCATCCCCACTCCATACA | 64 | 1536 |
| 1398786 | N/A | N/A | 21338 | 21357 | TCCCAATTCCAAATCTAGCT | 40 | 1537 |
| 1398789 | N/A | N/A | 262623 | 262642 | TCGAAGGATAATATTCCCTA | 46 | 1538 |
| 1398812 | N/A | N/A | 104019 | 104038 | ACCACCTTTTACCAGGCATT | 36 | 1539 |
| 1398823 | N/A | N/A | 15645 | 15664 | CTACCCATTTTCCTCTATCC | 64 | 1540 |
| 1398842 | N/A | N/A | 102877 | 102896 | GCTGCAGCACATTTGCGGAT | 68 | 1541 |
| 1398885 | N/A | N/A | 215094 | 215113 | TCAGCCCTATGACAGAGTCA | 53 | 1542 |
| 1398887 | 506 | 525 | 122811 | 122830 | TTGGTACTCTTCTCACTGCA | 46 | 1543 |
| 1398891 | N/A | N/A | 101392 | 101411 | ATGCTTGATTCATTTGATTC | 41 | 1544 |
| 1398909 | N/A | N/A | 231919 | 231938 | GCAACATGCACAATGTAGCT | 41 | 1545 |
| 1398925 | N/A | N/A | 37366 | 37385 | AGTCCACCTCATCTTTTTCT | 54 | 1546 |
| 1398940 | N/A | N/A | 268172 | 268191 | CCTCACCATCATCTGACCTT | 68 | 1547 |
| 1398945 | N/A | N/A | 285265 | 285284 | GTCAACTTCTCCTCTGACAT | 62 | 1548 |
| 1398969 | N/A | N/A | 17510 | 17529 | GAGTGCCAACCTTTTCAGTT | 30 | 1549 |
| 1398976 | N/A | N/A | 45949 | 45968 | GCTGACTATATAACCACATA | 43 | 1550 |
| 1398980 | N/A | N/A | 243869 | 243888 | GCCGTAGCAAGACTTGCCCA | 28 | 1551 |
| 1398985 | N/A | N/A | 119671 | 119690 | TCTTGCTTGCCATTATACCC | 73 | 1552 |
| 1399087 | N/A | N/A | 154394 | 154413 | GCTCATCATCCATTCCACAT | 16 | 1553 |
| 1399088 | N/A | N/A | 288705 | 288724 | CCAATCTCTTCCTCATGGCT | 69 | 1554 |
| 1399096 | N/A | N/A | 39067 | 39086 | GTTCTTCCTTAAAACTTCGA | 56 | 1555 |
| 1399143 | N/A | N/A | 49230 | 49249 | ACATGCCGTTCCCACTCTAC | 97 | 1556 |
| 1399147 | N/A | N/A | 221342 | 221361 | TCATCAACTTTTTAGTCCTT | 20 | 1557 |

TABLE 20-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1399150 | 2444 | 2463 | 292428 | 292447 | AATGAGTAAATCATAAAACG | 65 | 1558 |
| 1399163 | N/A | N/A | 208570 | 208589 | GGTCCTGCTTCATACATCCT | 49 | 1559 |
| 1399168 | N/A | N/A | 178601 | 178620 | CAAATGTGATTTCACTAACC | 72 | 1560 |
| 1399186 | N/A | N/A | 8466 | 8485 | TGCTGCCTTCTCTACATACC | 53 | 1561 |
| 1399207 | N/A | N/A | 104549 | 104568 | GCTGCAGCACTCTCTGCAGT | 87 | 1562 |
| 1399218 | N/A | N/A | 86603 | 86622 | AGCAAATGATTATCTAGTCC | 28 | 1563 |
| 1399233 | N/A | N/A | 80559 | 80578 | GCATATTCACATCATGGTTC | 46 | 1564 |
| 1399239 | 1182 | 1201 | 191581 | 191600 | GGCATGTTCATTCTCATCCC | 25 | 1565 |
| 1399250 | N/A | N/A | 203152 | 203171 | ACGAGCTCTTTAACGGCTCC | 108 | 1566 |
| 1399264 | N/A | N/A | 31982 | 32001 | TGCCTAGCCACACTATATAC | 66 | 1567 |
| 1399267 | N/A | N/A | 22914 | 22933 | GCATTTCATCACAATTTGTT | 32 | 1568 |
| 1399346 | N/A | N/A | 184458 | 184477 | CGTGGCCATCTCCAACAGGC | 75 | 1569 |
| 1399363 | N/A | N/A | 47535 | 47554 | AGCTCCTTTACCCTGACACT | 54 | 1570 |
| 1399383 | N/A | N/A | 29345 | 29364 | ATTCTCTTGAACAACTTTCT | 53 | 1571 |
| 1399388 | N/A | N/A | 10557 | 10576 | TGCACTTCATTCATCAGGAT | 37 | 1572 |
| 1399393 | N/A | N/A | 176165 | 176184 | GTCCACCCATCTAACTGATC | 69 | 1573 |
| 1399443 | N/A | N/A | 67152 | 67171 | GCTGACTCACCATTGACCCA | 80 | 1574 |
| 1399497 | N/A | N/A | 61676 | 61695 | GCTACAGATGTTCTTAGCCA | 51 | 1575 |

TABLE 21

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 20 | 178 |
| 1396902 | N/A | N/A | 288817 | 288836 | TGGATCTTTAATCTCCAGCC | 50 | 1576 |
| 1397577 | N/A | N/A | 33640 | 33659 | TGTCAACACTAACCCAACTT | 109 | 1577 |
| 1397645 | N/A | N/A | 263070 | 263089 | ATCTGCATCTCTGCAGGCCC | 44 | 1578 |
| 1397687 | 2446 | 2465 | 292430 | 292449 | ATAATGAGTAAATCATAAAA | 53 | 1579 |
| 1397706 | N/A | N/A | 34952 | 34971 | TCCCATACATGATTTTAGGT | 24 | 1580 |
| 1397708 | N/A | N/A | 170608 | 170627 | GTTGGTTCTCCCAATCCTGT | 53 | 1581 |
| 1397719 | N/A | N/A | 102953 | 102972 | TCAAATTGTACACACCAGGC | 61 | 1582 |
| 1397788 | N/A | N/A | 52800 | 52819 | TTGCTGCATAGACCTAGCCA | 67 | 1583 |
| 1397793 | N/A | N/A | 50771 | 50790 | TGTCATAACATTTACTCATC | 58 | 1584 |
| 1397823 | N/A | N/A | 10373 | 10392 | TTCTGTCATTACACATCCTC | 63 | 1585 |

TABLE 21-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1397845 | 2155 | 2174 | 282189 | 282208 | TCGCTATGACAACACCGCCC | 57 | 1586 |
| 1397891 | N/A | N/A | 159557 | 159576 | ATTCATTCTATTTGGTGCTC | 56 | 1587 |
| 1397913 | N/A | N/A | 104551 | 104570 | ATGCTGCAGCACTCTCTGCA | 103 | 1588 |
| 1397946 | N/A | N/A | 91196 | 91215 | GGCCCACATTTCACCCACCT | 73 | 1589 |
| 1397953 | N/A | N/A | 61715 | 61734 | CCCGGTCTTCAACACTCCTT | 83 | 1590 |
| 1397960 | N/A | N/A | 49243 | 49262 | ATGGTTATCAAACACATGCC | 95 | 1591 |
| 1398031 | N/A | N/A | 42517 | 42536 | TGGCTCTTTTTACTAAGCCA | 129 | 1592 |
| 1398034 | N/A | N/A | 154395 | 154414 | TGCTCATCATCCATTCCACA | 22 | 1593 |
| 1398037 | N/A | N/A | 208571 | 208590 | TGGTCCTGCTTCATACATCC | 59 | 1594 |
| 1398040 | N/A | N/A | 178603 | 178622 | CGCAAATGTGATTTCACTAA | 32 | 1595 |
| 1398104 | 2018 | 2037 | 276348 | 276367 | TCAGAGATCTCCTCCGTCTT | 65 | 1596 |
| 1398156 | N/A | N/A | 32046 | 32065 | CATACCCAATTACATCCAGT | 93 | 1597 |
| 1398160 | N/A | N/A | 285266 | 285285 | TGTCAACTTCTCCTCTGACA | 63 | 1598 |
| 1398203 | N/A | N/A | 101459 | 101478 | GCTTAATTATATATCTTCAC | 33 | 1599 |
| 1398218 | N/A | N/A | 223727 | 223746 | ATGCCAGCTCTTTTCTCCGT | 56 | 1600 |
| 1398232 | N/A | N/A | 6279 | 6298 | CCATTCCTCATTTAACCTCG | 57 | 1601 |
| 1398264 | N/A | N/A | 17696 | 17715 | TGCAACTAATTTTTGCAATC | 37 | 1602 |
| 1398278 | N/A | N/A | 19671 | 19690 | GGTCCATCTCTCCCCTTCCT | 61 | 1603 |
| 1398287 | N/A | N/A | 272248 | 272267 | CCAGCTCTCTCTTCCTGTAA | 51 | 1604 |
| 1398314 | N/A | N/A | 86700 | 86719 | TAGGGTCTAATTTCAGGTCC | 46 | 1605 |
| 1398327 | N/A | N/A | 164959 | 164978 | ACGATTGTTTTCCAAGGGCC | 57 | 1606 |
| 1398346 | N/A | N/A | 120247 | 120266 | CCCTACTTTTCTTTCTTGGA | 97 | 1607 |
| 1398351 | N/A | N/A | 46001 | 46020 | CCTGCTATTTATTCAGGAAC | 66 | 1608 |
| 1398377 | N/A | N/A | 96344 | 96363 | TCTCTCCTGCGACCAGCCTC | 69 | 1609 |
| 1398436 | N/A | N/A | 244550 | 244569 | CTTTATCACTTTACTATGCA | 52 | 1610 |
| 1398438 | N/A | N/A | 215236 | 215255 | TTATTTCTTTCACTCAGGCC | 95 | 1611 |
| 1398454 | N/A | N/A | 28010 | 28029 | TGCGCATTTATACAATATAC | 33 | 1612 |
| 1398485 | N/A | N/A | 221344 | 221363 | GGTCATCAACTTTTTAGTCC | 21 | 1613 |
| 1398488 | 507 | 526 | 122812 | 122831 | GTTGGTACTCTTCTCACTGC | 43 | 1614 |
| 1398606 | N/A | N/A | 31589 | 31608 | GCTTATTTTCACCAAGCCTC | 55 | 1615 |
| 1398616 | N/A | N/A | 176179 | 176198 | CTCTACTTATTCTTGTCCAC | 61 | 1616 |
| 1398671 | N/A | N/A | 22917 | 22936 | GCAGCATTTCATCACAATTT | 40 | 1617 |
| 1398699 | N/A | N/A | 104020 | 104039 | CACCACCTTTTACCAGCAT | 30 | 1618 |
| 1398819 | N/A | N/A | 68100 | 68119 | GGTCATTCTTCTATTTTGCC | 46 | 1619 |
| 1398824 | N/A | N/A | 8499 | 8518 | GCCCTGGTCTAAACTCTCCT | 47 | 1620 |
| 1398832 | N/A | N/A | 203154 | 203173 | CCACGAGCTCTTTAACGGCT | 87 | 1621 |

TABLE 21-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398841 | N/A | N/A | 155251 | 155270 | TTGCTATCTCTCAATGACCA | 30 | 1622 |
| 1398859 | N/A | N/A | 47536 | 47555 | GAGCTCCTTTACCCTGACAC | 67 | 1623 |
| 1398898 | N/A | N/A | 15684 | 15703 | GCTCACGGAGAATCTTAGCT | 45 | 1624 |
| 1398907 | N/A | N/A | 92820 | 92839 | GCTCAGAATTACACACTAAT | 46 | 1625 |
| 1398926 | N/A | N/A | 24601 | 24620 | CCTGGTTCATAGAATGAGCT | 48 | 1626 |
| 1398954 | N/A | N/A | 142804 | 142823 | GCATCTCCTTCCACTGTGTC | 78 | 1627 |
| 1398987 | N/A | N/A | 89898 | 89917 | GTCTCCTCAACTCATCCTCT | 45 | 1628 |
| 1399051 | N/A | N/A | 232183 | 232202 | GCAACAGGCCACTAACATGC | 70 | 1629 |
| 1399052 | N/A | N/A | 29366 | 29385 | ACAGATGTCTTATCATGGTC | 44 | 1630 |
| 1399094 | N/A | N/A | 189280 | 189299 | CTAGCTTTAGTCATCTTCTC | 51 | 1631 |
| 1399095 | N/A | N/A | 80565 | 80584 | TGGCAGGCATATTCACATCA | 105 | 1632 |
| 1399105 | N/A | N/A | 184557 | 184576 | GCATTTGTTTCCTCAGGCTC | 41 | 1633 |
| 1399126 | N/A | N/A | 14160 | 14179 | GTGTCCCTACAATATGACCC | 51 | 1634 |
| 1399145 | N/A | N/A | 22177 | 22196 | GCAAAGCTCCTAACACGCCA | 59 | 1635 |
| 1399148 | N/A | N/A | 39109 | 39128 | GCCACAGTATCACATGACCA | 25 | 1636 |
| 1399162 | N/A | N/A | 113517 | 113536 | GCATACTTACAATTATGTCT | 55 | 1637 |
| 1399170 | N/A | N/A | 126849 | 126868 | TACCTCTTTTTCATACCTCT | 33 | 1638 |
| 1399253 | N/A | N/A | 10558 | 10577 | CTGCACTTCATTCATCAGGA | 17 | 1639 |
| 1399259 | N/A | N/A | 259951 | 259970 | GTAGGTACACAACTGTACTC | 49 | 1640 |
| 1399266 | N/A | N/A | 105139 | 105158 | GCCTCCTCCACTCTTTCAAT | 63 | 1641 |
| 1399350 | N/A | N/A | 56532 | 56551 | GCAGTTGCTCATTTCATCAC | 56 | 1642 |
| 1399401 | 1237 | 1256 | 191636 | 191655 | GGGACATTCTCTCTCGGTGC | 49 | 1643 |
| 1399412 | N/A | N/A | 7590 | 7609 | GCATTTCCCATCCATCCCCA | 81 | 1644 |
| 1399416 | N/A | N/A | 37370 | 37389 | CCTTAGTCCACCTCATCTTT | 103 | 1645 |
| 1399428 | N/A | N/A | 98500 | 98519 | TTTGCAGGATACTACAGGCT | 39 | 1646 |
| 1399434 | N/A | N/A | 268182 | 268201 | GCATGATATTCCTCACCATC | 50 | 1647 |
| 1399445 | N/A | N/A | 26676 | 26695 | AGCTCAGAATTCACTTGACA | 77 | 1648 |
| 1399486 | N/A | N/A | 132721 | 132740 | AGGGTTATTTTTCCATGTCA | 58 | 1649 |
| 1399501 | N/A | N/A | 12782 | 12801 | TCTCTCTCCCACCACTTGTT | 61 | 1650 |
| 1399511 | N/A | N/A | 87698 | 87717 | GCCAACTTATTCTCAAGGGA | 22 | 1651 |
| 1399513 | N/A | N/A | 84438 | 84457 | GCTGCAGCTTCACATTAGAT | 42 | 1652 |

TABLE 22

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 15 | 178 |
| 1397574 | N/A | N/A | 92823 | 92842 | CAGGCTCAGAATTACACACT | 47 | 1653 |
| 1397579 | N/A | N/A | 7591 | 7610 | GGCATTTCCCATCCATCCCC | 36 | 1654 |
| 1397654 | N/A | N/A | 264160 | 264179 | CCAGGTCTTTGATAATGAAC | 46 | 1655 |
| 1397662 | N/A | N/A | 10374 | 10393 | CTTCTGTCATTACACATCCT | 58 | 1656 |
| 1397690 | N/A | N/A | 10588 | 10607 | GTCCATCATTAATAAGACCT | 45 | 1657 |
| 1397693 | N/A | N/A | 127382 | 127401 | GCACACGCTCACCAGTGTCT | 41 | 1658 |
| 1397738 | N/A | N/A | 32052 | 32071 | CCGGTACATACCCAATTACA | 62 | 1659 |
| 1397802 | N/A | N/A | 80566 | 80585 | GTGGCAGGCATATTCACATC | 53 | 1660 |
| 1397825 | N/A | N/A | 24618 | 24637 | AGCACTTTTCAACAAGGCCT | 38 | 1661 |
| 1397826 | N/A | N/A | 120754 | 120773 | GCTGGTACCTCTTTGGCGAC | 87 | 1662 |
| 1397830 | N/A | N/A | 33645 | 33664 | CAGCATGTCAACACTAACCC | 46 | 1663 |
| 1397846 | N/A | N/A | 155652 | 155671 | CTGCAGTATCTCATCTTTGC | 30 | 1664 |
| 1397877 | N/A | N/A | 47537 | 47556 | AGAGCTCCTTTACCCTGACA | 91 | 1665 |
| 1397922 | N/A | N/A | 35072 | 35091 | TTTCTTCGATATTATTGTCT | 48 | 1666 |
| 1397993 | N/A | N/A | 6280 | 6299 | GCCATTCCTCATTTAACCTC | 23 | 1667 |
| 1397999 | N/A | N/A | 91199 | 91218 | GGAGGCCCACATTTCACCCA | 79 | 1668 |
| 1398016 | N/A | N/A | 22179 | 22198 | CAGCAAAGCTCCTAACACGC | 70 | 1669 |
| 1398077 | N/A | N/A | 86713 | 86732 | CTACTTGTCATATTAGGGTC | 30 | 1670 |
| 1398103 | N/A | N/A | 259968 | 259987 | CCTGATCCATGCACTTGGTA | 84 | 1671 |
| 1398105 | N/A | N/A | 56792 | 56811 | CGATACTATTTCTATCACAT | 71 | 1672 |
| 1398106 | N/A | N/A | 52820 | 52839 | CCTCAGTTATCACCTGGGTT | 55 | 1673 |
| 1398139 | 658 | 677 | 122963 | 122982 | TGTCTGCTCCGCCCCACCAG | 8† | 1674 |
| 1398161 | N/A | N/A | 12794 | 12813 | TCAACACTAACTTCTCTCTC | 67 | 1675 |
| 1398170 | 2476 | 2495 | 292460 | 292479 | CTTGTGTTACAGCACAGCTG | 22 | 1676 |
| 1398252 | N/A | N/A | 113542 | 113561 | GTCCTTTATCCACTAACTCT | 82 | 1677 |
| 1398261 | N/A | N/A | 272249 | 272268 | TCCAGCTCTCTCTTCCTGTA | 50 | 1678 |
| 1398297 | 2019 | 2038 | 276349 | 276368 | TTCAGAGATCCTCCGTCT | 79 | 1679 |
| 1398305 | N/A | N/A | 215826 | 215845 | GCATTACTACTTCAAGCTAA | 75 | 1680 |
| 1398317 | N/A | N/A | 37381 | 37400 | CAGTGTATTTACCTTAGTCC | 32 | 1681 |
| 1398356 | 173 | 192 | 61936 | 61955 | TCCCACTTCCCATTCTGGAC | 50 | 1682 |
| 1398393 | N/A | N/A | 26681 | 26700 | ATGCAAGCTCAGAATTCACT | 113 | 1683 |
| 1398406 | N/A | N/A | 50772 | 50791 | GTGTCATAACATTTACTCAT | 33 | 1684 |
| 1398435 | N/A | N/A | 192183 | 192202 | TCTGGCTCACTGATTTTGCT | 54 | 1685 |
| 1398458 | N/A | N/A | 232992 | 233011 | CTGAAATATTCCCTGGGCAT | 49 | 1686 |
| 1398479 | N/A | N/A | 88098 | 88117 | TACTACTTACACATTTGGAA | 65 | 1687 |

TABLE 22-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398505 | N/A | N/A | 159558 | 159577 | CATTCATTCTATTTGGTGCT | 22 | 1688 |
| 1398519 | N/A | N/A | 17699 | 17718 | CGTTGCAACTAATTTTTGCA | 46 | 1689 |
| 1398540 | N/A | N/A | 68101 | 68120 | GGGTCATTCTTCTATTTTGC | 66 | 1690 |
| 1398547 | N/A | N/A | 96352 | 96371 | TGGAGGCCTCTCTCCTGCGA | 74 | 1691 |
| 1398575 | N/A | N/A | 244552 | 244571 | CTCTTTATCACTTTACTATG | 36 | 1692 |
| 1398611 | N/A | N/A | 142807 | 142826 | CTGGCATCTCCTTCCACTGT | 79 | 1693 |
| 1398613 | N/A | N/A | 104597 | 104616 | CCCTTCCATCCACTACAGCT | 94 | 1694 |
| 1398636 | N/A | N/A | 84537 | 84556 | CCCAATTCCAATTCCTCTAC | 60 | 1695 |
| 1398644 | N/A | N/A | 221345 | 221364 | TGGTCATCAACTTTTTAGTC | 17 | 1696 |
| 1398647 | N/A | N/A | 39110 | 39129 | TGCCACAGTATCACATGACC | 44 | 1697 |
| 1398669 | N/A | N/A | 268188 | 268207 | TGGACAGCATGATATTCCTC | 48 | 1698 |
| 1398680 | N/A | N/A | 8510 | 8529 | CATGCATTCCTGCCCTGGTC | 48 | 1699 |
| 1398724 | N/A | N/A | 19675 | 19694 | GACAGGTCCATCTCTCCCCT | 50 | 1700 |
| 1398737 | N/A | N/A | 22943 | 22962 | ACGACCTTACACTAGGTTCT | 28 | 1701 |
| 1398759 | N/A | N/A | 165103 | 165122 | AGTTTCTTACTTCCTGTCTC | 60 | 1702 |
| 1398760 | N/A | N/A | 288973 | 288992 | TTTGCTACTTGATAATCCTA | 67 | 1703 |
| 1398788 | N/A | N/A | 133089 | 133108 | GCATTAGTCTACCACCTACA | 60 | 1704 |
| 1398803 | N/A | N/A | 205070 | 205089 | TGTCTGCATTTTCCAGGCAC | 71 | 1705 |
| 1398844 | N/A | N/A | 98555 | 98574 | CCCAACCTATTACCCTACAA | 70 | 1706 |
| 1398850 | N/A | N/A | 184656 | 184675 | CCATTTCATATTCATACTAA | 60 | 1707 |
| 1398874 | N/A | N/A | 104021 | 104040 | GCACCACCTTTTACCAGGCA | 35 | 1708 |
| 1398895 | N/A | N/A | 154396 | 154415 | GTGCTCATCATCCATTCCAC | 25 | 1709 |
| 1398908 | 2159 | 2178 | 282193 | 282212 | ACTGTCGCTATGACAACACC | 86 | 1710 |
| 1398998 | N/A | N/A | 49405 | 49424 | TCCTGCTGCTAAAAGCCTTC | 76 | 1711 |
| 1399004 | N/A | N/A | 14298 | 14317 | AATGTCTTTTCTCTGCAAC | 48 | 1712 |
| 1399010 | N/A | N/A | 101460 | 101479 | TGCTTAATTATATATCTTCA | 37 | 1713 |
| 1399102 | N/A | N/A | 42518 | 42537 | TTGGCTCTTTTTACTAAGCC | 43 | 1714 |
| 1399104 | N/A | N/A | 102957 | 102976 | TCATTCAAATTGTACACACC | 64 | 1715 |
| 1399153 | N/A | N/A | 208572 | 208591 | GTGGTCCTGCTTCATACATC | 33 | 1716 |
| 1399169 | N/A | N/A | 170856 | 170875 | GCCTCATTCTATAACAGCTA | 46 | 1717 |
| 1399202 | N/A | N/A | 31590 | 31609 | TGCTTATTTTCACCAAGCCT | 68 | 1718 |
| 1399223 | N/A | N/A | 285543 | 285562 | GTGGTCTATTTCAACATTGC | 55 | 1719 |
| 1399226 | N/A | N/A | 189288 | 189307 | GTGCTTCCCTAGCTTTAGTC | 47 | 1720 |
| 1399260 | N/A | N/A | 89899 | 89918 | AGTCTCCTCAACTCATCCTC | 61 | 1721 |
| 1399261 | N/A | N/A | 28029 | 28048 | CTCATAATATCCTCATCTGT | 77 | 1722 |
| 1399296 | N/A | N/A | 179065 | 179084 | TAGCACTGCAAAACCCTTCA | 82 | 1723 |

TABLE 22-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1399343 | N/A | N/A | 176192 | 176211 | TGAGGCTTATACTCTCTACT | 58 | 1724 |
| 1399353 | N/A | N/A | 223737 | 223756 | TGTCACTCAAATGCCAGCTC | 22 | 1725 |
| 1399418 | N/A | N/A | 105146 | 105165 | GTCAACAGCCTCCTCCACTC | 98 | 1726 |
| 1399442 | N/A | N/A | 29523 | 29542 | GCACAAACATTTTATATCTT | 40 | 1727 |
| 1399456 | N/A | N/A | 15788 | 15807 | AGCATTTCCTACCTCCTCCT | 79 | 1728 |
| 1399494 | N/A | N/A | 46260 | 46279 | CCTCTTGATTTCCTTTATCT | 87 | 1729 |

TABLE 23

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 19 | 178 |
| 1396906 | N/A | N/A | 22216 | 22235 | GCAACACTCACTCACCCATT | 35 | 1730 |
| 1397534 | N/A | N/A | 31591 | 31610 | GTGCTTATTTTCACCAAGCC | 22 | 1731 |
| 1397545 | N/A | N/A | 244553 | 244572 | TCTCTTTATCACTTTACTAT | 53 | 1732 |
| 1397572 | N/A | N/A | 224068 | 224087 | TGGCAAACTCTCTTAGGTTC | 20 | 1733 |
| 1397580 | N/A | N/A | 22944 | 22963 | CACGACCTTACACTAGGTTC | 21 | 1734 |
| 1397607 | N/A | N/A | 89900 | 89919 | CAGTCTCCTCAACTCATCCT | 46 | 1735 |
| 1397615 | N/A | N/A | 14300 | 14319 | CCAATGTCTTTTTCTCTGCA | 39 | 1736 |
| 1397620 | N/A | N/A | 17954 | 17973 | ACTTCATTTATGCTATGCCT | 31 | 1737 |
| 1397621 | N/A | N/A | 42519 | 42538 | GTTGGCTCTTTTTACTAAGC | 59 | 1738 |
| 1397623 | N/A | N/A | 101562 | 101581 | TGCTGAGACCACATCTGTTT | 48 | 1739 |
| 1397655 | N/A | N/A | 159560 | 159579 | TGCATTCATTCTATTTGGTG | 22 | 1740 |
| 1397711 | N/A | N/A | 11246 | 11265 | ATCTCTTATTCTCATAAGTA | 26 | 1741 |
| 1397792 | N/A | N/A | 285597 | 285616 | AGGTTCTACCATCCCAGCTA | 75 | 1742 |
| 1397855 | N/A | N/A | 15817 | 15836 | CTTGGATGTTTCTACCATAA | 35 | 1743 |
| 1397862 | N/A | N/A | 155838 | 155857 | TCCCTCCATTTCTTTCCGGT | 41 | 1744 |
| 1397885 | N/A | N/A | 208594 | 208613 | GCATATTCATACTTGGACTA | 41 | 1745 |
| 1397919 | N/A | N/A | 6281 | 6300 | AGCCATTCCTCATTTAACCT | 36 | 1746 |
| 1397924 | N/A | N/A | 91222 | 91241 | GCCCACTATCAACTCTGTAA | 63 | 1747 |
| 1397996 | N/A | N/A | 80651 | 80670 | ACTGCATCTTTCTAAAGGGT | 47 | 1748 |
| 1398030 | N/A | N/A | 12805 | 12824 | TGTGATCACAATCAACACTA | 30 | 1749 |
| 1398033 | N/A | N/A | 28031 | 28050 | CTCTCATAATATCCTCATCT | 53 | 1750 |
| 1398060 | N/A | N/A | 92843 | 92862 | ACACCATATTACTTATGCAC | 32 | 1751 |
| 1398088 | N/A | N/A | 32084 | 32103 | GAAGGCCCTCAACCTGCACA | 70 | 1752 |

TABLE 23-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398152 | N/A | N/A | 7592 | 7611 | CGGCATTTCCCATCCATCCC | 35 | 1753 |
| 1398198 | 2478 | 2497 | 292462 | 292481 | TACTTGTGTTACAGCACAGC | 31 | 1754 |
| 1398224 | N/A | N/A | 268343 | 268362 | GCAGTCTTTTTCTCACTTTT | 38 | 1755 |
| 1398233 | N/A | N/A | 98556 | 98575 | TCCCAACCTATTACCCTACA | 35 | 1756 |
| 1398263 | N/A | N/A | 50773 | 50792 | AGTGTCATAACATTTACTCA | 49 | 1757 |
| 1398275 | N/A | N/A | 233132 | 233151 | TGCTCAGCCCCATCCCTAGC | 69 | 1758 |
| 1398286 | 2189 | 2208 | 282223 | 282242 | TTCTTCAGCATCACCAAGGT | 95 | 1759 |
| 1398337 | N/A | N/A | 68137 | 68156 | CCTTTTCTAATCCATACCCA | 81 | 1760 |
| 1398446 | N/A | N/A | 189859 | 189878 | CTGCTTAATACATCCTGTTC | 48 | 1761 |
| 1398452 | N/A | N/A | 215828 | 215847 | TGGCATTACTACTTCAAGCT | 90 | 1762 |
| 1398455 | N/A | N/A | 29599 | 29618 | CCTGGTTTCATATATGGTTT | 38 | 1763 |
| 1398480 | 2020 | 2039 | 276350 | 276369 | CTTCAGAGATCTCCTCCGTC | 102 | 1764 |
| 1398490 | N/A | N/A | 133092 | 133111 | GTGGCATTAGTCTACCACCT | 47 | 1765 |
| 1398531 | N/A | N/A | 104610 | 104629 | CCATAGTTCCTCTCCCTTCC | 76 | 1766 |
| 1398533 | N/A | N/A | 184657 | 184676 | TCCATTTCATATTCATACTA | 55 | 1767 |
| 1398541 | N/A | N/A | 96456 | 96475 | CCATCAATACTGTATCTTTC | 25 | 1768 |
| 1398571 | N/A | N/A | 88104 | 88123 | GGTCATTACTACTTACACAT | 39 | 1769 |
| 1398661 | N/A | N/A | 49657 | 49676 | GCTACAGTTCAACTTGTCCA | 51 | 1770 |
| 1398705 | N/A | N/A | 56793 | 56812 | GCGATACTATTTCTATCACA | 40 | 1771 |
| 1398750 | N/A | N/A | 47541 | 47560 | GTCAAGAGCTCCTTTACCCT | 60 | 1772 |
| 1398771 | N/A | N/A | 24619 | 24638 | AAGCACTTTTCAACAAGGCC | 35 | 1773 |
| 1398790 | N/A | N/A | 37382 | 37401 | GCAGTGTATTTACCTTAGTC | 25 | 1774 |
| 1398796 | N/A | N/A | 10376 | 10395 | GGCTTCTGTCATTACACATC | 18 | 1775 |
| 1398821 | N/A | N/A | 179173 | 179192 | CCATGACTTTTTCAAATCAA | 39 | 1776 |
| 1398843 | N/A | N/A | 272254 | 272273 | GTGACTCCAGCTCTCTCTTC | 34 | 1777 |
| 1398853 | N/A | N/A | 170857 | 170876 | TGCCTCATTCTATAACAGCT | 47 | 1778 |
| 1398854 | N/A | N/A | 221517 | 221536 | GCTGCCCTATTCTTGGGCAT | 108 | 1779 |
| 1398894 | N/A | N/A | 105147 | 105166 | GGTCAACAGCCTCCTCCACT | 71 | 1780 |
| 1398935 | N/A | N/A | 176194 | 176213 | GCTGAGGCTTATACTCTCTA | 9 | 1781 |
| 1398975 | N/A | N/A | 143205 | 143224 | CGAGCAAATTCCTCATGTCC | 56 | 1782 |
| 1399022 | N/A | N/A | 205071 | 205090 | TTGTCTGCATTTTCCAGGCA | 37 | 1783 |
| 1399024 | 660 | 679 | 122965 | 122984 | TGTGTCTGCTCCGCCCCACC | 12† | 1784 |
| 1399029 | N/A | N/A | 192435 | 192454 | CCTCCATATTATCAAACTCC | 53 | 1785 |
| 1399178 | N/A | N/A | 165104 | 165123 | CAGTTCTTACTTCCTGTCT | 48 | 1786 |
| 1399224 | N/A | N/A | 26744 | 26763 | AGCCTGCTTTTCTCTTTCAC | 52 | 1787 |
| 1399236 | N/A | N/A | 39205 | 39224 | TCTCATTAGCATATAAGACC | 27 | 1788 |

TABLE 23-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1399247 | N/A | N/A | 264172 | 264191 | CAGGACAGTTTTCCAGGTCT | 37 | 1789 |
| 1399304 | N/A | N/A | 103082 | 103101 | TCCTCTTTTATCACTACAAC | 45 | 1790 |
| 1399361 | N/A | N/A | 8514 | 8533 | TGCCCATGCATTCCTGCCCT | 39 | 1791 |
| 1399364 | N/A | N/A | 259973 | 259992 | TCCCTCCTGATCCATGCACT | 48 | 1792 |
| 1399380 | N/A | N/A | 35657 | 35676 | GCAGATCATATACTATACAC | 21 | 1793 |
| 1399407 | N/A | N/A | 104022 | 104041 | GGCACCACCTTTTACCAGGC | 34 | 1794 |
| 1399408 | N/A | N/A | 46261 | 46280 | ACCTCTTGATTTCCTTTATC | 74 | 1795 |
| 1399422 | N/A | N/A | 120791 | 120810 | AGGAAATCTTCACTTTGCAA | 56 | 1796 |
| 1399429 | N/A | N/A | 63461 | 63480 | CATCATGGTTCATACTCCTT | 57 | 1797 |
| 1399461 | N/A | N/A | 84538 | 84557 | TCCCAATTCCAATTCCTCTA | 42 | 1798 |
| 1399469 | N/A | N/A | 33649 | 33668 | TCAACAGCATGTCAACACTA | 43 | 1799 |
| 1399477 | N/A | N/A | 19676 | 19695 | TGACAGGTCCATCTCTCCCC | 55 | 1800 |
| 1399478 | N/A | N/A | 127481 | 127500 | CCTCCAGATCTTAAGCAGCT | 74 | 1801 |
| 1399480 | N/A | N/A | 86776 | 86795 | GCAGCACCTATATTCCTTAA | 28 | 1802 |
| 1399481 | N/A | N/A | 289024 | 289043 | GCTGGTGCACAATCCAGACC | 32 | 1803 |
| 1399502 | N/A | N/A | 113769 | 113788 | TTGCACCATCACCACCTACT | 42 | 1804 |
| 1399503 | N/A | N/A | 154398 | 154417 | GTGTGCTCATCATCCATTCC | 19 | 1805 |
| 1399516 | N/A | N/A | 52872 | 52891 | CCAAATTTCACCATGTGGCA | 67 | 1806 |

TABLE 24

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 23 | 178 |
| 1396903 | N/A | N/A | 88284 | 88303 | ACAGTATTCAAATACATCCT | 36 | 1807 |
| 1397588 | N/A | N/A | 101591 | 101610 | AAGCTCTCCTCACACTGTAA | 39 | 1808 |
| 1397636 | N/A | N/A | 89902 | 89921 | GTCAGTCTCCTCAACTCATC | 28 | 1809 |
| 1397678 | N/A | N/A | 104612 | 104631 | TCCCATAGTTCCTCTCCCTT | 54 | 1810 |
| 1397685 | N/A | N/A | 272276 | 272295 | GCTGATTTCACCCTAAGCCC | 27 | 1811 |
| 1397686 | 2479 | 2498 | 292463 | 292482 | CTACTTGTGTTACAGCACAG | 9 | 1812 |
| 1397725 | N/A | N/A | 26769 | 26788 | GCAGAACTCCTTCCCAAAGA | 56 | 1813 |
| 1397732 | N/A | N/A | 32086 | 32105 | TGGAAGGCCCTCAACCTGCA | 51 | 1814 |
| 1397769 | N/A | N/A | 47542 | 47561 | AGTCAAGAGCTCCTTTACCC | 37 | 1815 |
| 1397798 | N/A | N/A | 19677 | 19696 | ATGACAGGTCCATCTCTCCC | 50 | 1816 |

TABLE 24-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1397817 | N/A | N/A | 8515 | 8534 | ATGCCCATGCATTCCTGCCC | 21 | 1817 |
| 1397840 | 661 | 680 | 122966 | 122985 | CTGTGTCTGCTCCGCCCCAC | 8† | 1818 |
| 1397948 | N/A | N/A | 13144 | 13163 | GAGGCATTTTTCTTTTTGC | 17 | 1819 |
| 1397959 | N/A | N/A | 159561 | 159580 | TTGCATTCATTCTATTTGGT | 25 | 1820 |
| 1397982 | N/A | N/A | 63472 | 63491 | TCATCATTTCACATCATGGT | 26 | 1821 |
| 1398082 | N/A | N/A | 84833 | 84852 | GCCTACTGATGAATACACTT | 56 | 1822 |
| 1398083 | N/A | N/A | 259975 | 259994 | GCTCCCTCCTGATCCATGCA | 44 | 1823 |
| 1398118 | N/A | N/A | 179198 | 179217 | CCATCTGAATTTGACCTCCA | 53 | 1824 |
| 1398122 | N/A | N/A | 120950 | 120969 | CGGGAACTCTATTTTCTGTT | 63 | 1825 |
| 1398125 | N/A | N/A | 86834 | 86853 | TCTGTATTATACTCTGGGCT | 20 | 1826 |
| 1398128 | N/A | N/A | 35659 | 35678 | TGGCAGATCATATACTATAC | 12 | 1827 |
| 1398200 | N/A | N/A | 96460 | 96479 | GCATCCATCAATACTGTATC | 26 | 1828 |
| 1398213 | N/A | N/A | 233347 | 233366 | ATGCATCAATTCCTTTGGGT | 18 | 1829 |
| 1398228 | N/A | N/A | 18325 | 18344 | GTGCACCAACAATAAATCAA | 26 | 1830 |
| 1398231 | N/A | N/A | 57207 | 57226 | CTGCATTTGAACCACCCGCT | 72 | 1831 |
| 1398270 | N/A | N/A | 176195 | 176214 | TGCTGAGGCTTATACTCTCT | 30 | 1832 |
| 1398279 | N/A | N/A | 282276 | 282295 | AGTCAAGTTTACCTACCTCC | 73 | 1833 |
| 1398282 | N/A | N/A | 22218 | 22237 | CAGCAACACTCACTCACCCA | 48 | 1834 |
| 1398336 | N/A | N/A | 269083 | 269102 | GGTCACTTCAAATTCTACTC | 23 | 1835 |
| 1398372 | N/A | N/A | 165105 | 165124 | TCAGTTTCTTACTTCCTGTC | 40 | 1836 |
| 1398373 | N/A | N/A | 104163 | 104182 | GATGCAGAACTATTTAGGGC | 34 | 1837 |
| 1398385 | N/A | N/A | 80737 | 80756 | GCTGCAGCACTCATGAGTCA | 65 | 1838 |
| 1398420 | N/A | N/A | 46362 | 46381 | ACCCACACATGAAAGTACCA | 44 | 1839 |
| 1398422 | N/A | N/A | 205072 | 205091 | GTTGTCTGCATTTTCCAGGC | 27 | 1840 |
| 1398429 | N/A | N/A | 22945 | 22964 | CCACGACCTTACACTAGGTT | 5 | 1841 |
| 1398585 | N/A | N/A | 6282 | 6301 | CAGCCATTCCTCATTTAACC | 16 | 1842 |
| 1398587 | N/A | N/A | 98573 | 98592 | CTGATTATAATACTTTGTCC | 37 | 1843 |
| 1398649 | N/A | N/A | 7593 | 7612 | ACGGCATTTCCCATCCATCC | 20 | 1844 |
| 1398666 | N/A | N/A | 113774 | 113793 | GTTCATTGCACCATCACCAC | 43 | 1845 |
| 1398698 | N/A | N/A | 92927 | 92946 | ATCTTCTTTTACCACATCAA | 43 | 1846 |
| 1398732 | N/A | N/A | 128188 | 128207 | TGGCCATACGCACCCACACA | 27 | 1847 |
| 1398746 | N/A | N/A | 244554 | 244573 | GTCTCTTTATCACTTTACTA | 26 | 1848 |
| 1398747 | N/A | N/A | 50786 | 50805 | TATTTCCTTTCAAAGTGTCA | 48 | 1849 |
| 1398766 | N/A | N/A | 52888 | 52907 | TCGCACTGAGATCCTACCAA | 61 | 1850 |
| 1398772 | N/A | N/A | 155923 | 155942 | AGACATCTTCTCATTTGGGT | 17 | 1851 |
| 1398785 | N/A | N/A | 134292 | 134311 | GCACCTTCAAATGTCTGACA | 38 | 1852 |

TABLE 24-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398798 | N/A | N/A | 264375 | 264394 | GTGCACGCAGATTTTCTCCT | 45 | 1853 |
| 1398799 | N/A | N/A | 10392 | 10411 | TGTTTATCACAAATATGGCT | 46 | 1854 |
| 1398858 | N/A | N/A | 105169 | 105188 | AGACATATCATCCATGCCTA | 43 | 1855 |
| 1398886 | N/A | N/A | 31594 | 31613 | CCTGTGCTTATTTTCACCAA | 51 | 1856 |
| 1398906 | N/A | N/A | 289150 | 289169 | GCTGTCAACAATCATTTGCA | 30 | 1857 |
| 1398934 | N/A | N/A | 37431 | 37450 | CCATGCCCATTTGATTTATA | 30 | 1858 |
| 1398959 | 2021 | 2040 | 276351 | 276370 | ACTTCAGAGATCTCCTCCGT | 42 | 1859 |
| 1398965 | N/A | N/A | 208596 | 208615 | TTGCATATTCATACTTGGAC | 27 | 1860 |
| 1399012 | N/A | N/A | 215829 | 215848 | TTGGCATTACTACTTCAAGC | 43 | 1861 |
| 1399063 | N/A | N/A | 68149 | 68168 | CCAGCCTACAAGCCTTTTCT | 51 | 1862 |
| 1399067 | N/A | N/A | 189861 | 189880 | CTCTGCTTAATACATCCTGT | 50 | 1863 |
| 1399080 | N/A | N/A | 224104 | 224123 | CCACTTTCATCACTTTACTA | 57 | 1864 |
| 1399083 | N/A | N/A | 192593 | 192612 | AGATCTTTATTCATTCACTT | 44 | 1865 |
| 1399141 | N/A | N/A | 42531 | 42550 | ACTCATATATTTGTTGGCTC | 48 | 1866 |
| 1399149 | N/A | N/A | 171299 | 171318 | ACAGAATCCCTTCACCCCAT | 43 | 1867 |
| 1399187 | N/A | N/A | 184661 | 184680 | GCACTCCATTTCATATTCAT | 33 | 1868 |
| 1399199 | N/A | N/A | 103083 | 103102 | ATCCTCTTTTATCACTACAA | 35 | 1869 |
| 1399201 | N/A | N/A | 11268 | 11287 | ATGACTTTTCTTTATGCAAC | 25 | 1870 |
| 1399211 | N/A | N/A | 15868 | 15887 | ATGCAAGTCTGAACCATCTA | 35 | 1871 |
| 1399212 | N/A | N/A | 39408 | 39427 | ATCCAACCCTCCAGGAACCT | 59 | 1872 |
| 1399234 | N/A | N/A | 154401 | 154420 | TGTGTGTGCTCATCATCCAT | 26 | 1873 |
| 1399298 | N/A | N/A | 49873 | 49892 | GCCAACAATTAAGAAACACC | 31 | 1874 |
| 1399340 | N/A | N/A | 28033 | 28052 | TGCTCTCATAATATCCTCAT | 37 | 1875 |
| 1399341 | N/A | N/A | 24620 | 24639 | AAAGCACTTTTCAACAAGGC | 42 | 1876 |
| 1399359 | N/A | N/A | 14301 | 14320 | TCCAATGTCTTTTTCTCTGC | 19 | 1877 |
| 1399384 | N/A | N/A | 33676 | 33695 | CAGAGCTTCCATCCTCGGGA | 51 | 1878 |
| 1399386 | N/A | N/A | 91237 | 91256 | TCCCATCCCCTTCAGGCCCA | 42 | 1879 |
| 1399390 | N/A | N/A | 285598 | 285617 | CAGGTTCTACCATCCCAGCT | 41 | 1880 |
| 1399436 | N/A | N/A | 221519 | 221538 | GTGCTGCCCTATTCTTGGGC | 9 | 1881 |
| 1399500 | N/A | N/A | 29618 | 29637 | GCAGAATACCAAGTTAGTAC | 22 | 1882 |
| 1399508 | N/A | N/A | 145247 | 145266 | GCTGTGCTTTACCAAGTGCC | 60 | 1883 |

TABLE 25

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 38 | 178 |
| 1397530 | N/A | N/A | 15902 | 15921 | GTTCCATCACTCTAGCTGGA | 28 | 1884 |
| 1397551 | N/A | N/A | 22950 | 22969 | GGACTCCACGACCTTACACT | 48 | 1885 |
| 1397563 | N/A | N/A | 264451 | 264470 | AGGGCTTTGCTCAAATGGAC | 75 | 1886 |
| 1397614 | N/A | N/A | 158123 | 158142 | GCGATCCTCAACTCTACTTC | 17 | 1887 |
| 1397619 | N/A | N/A | 86835 | 86854 | CTCTGTATTATACTCTGGGC | 104 | 1888 |
| 1397628 | N/A | N/A | 146473 | 146492 | TAGCCAGTACTTCTCCCGCA | 66 | 1889 |
| 1397637 | N/A | N/A | 285601 | 285620 | GTTCAGGTTCTACCATCCCA | 40 | 1890 |
| 1397639 | N/A | N/A | 42533 | 42552 | TCACTCATATATTTGTTGGC | 70 | 1891 |
| 1397643 | N/A | N/A | 272308 | 272327 | GCAGGCTTACTTAGAGGTCT | 52 | 1892 |
| 1397736 | N/A | N/A | 113775 | 113794 | TGTTCATTGCACCATCACCA | 61 | 1893 |
| 1397746 | N/A | N/A | 26879 | 26898 | CTTCTGGTTTTTATTGGCT | 45 | 1894 |
| 1397763 | N/A | N/A | 7594 | 7613 | GACGGCATTTCCCATCCATC | 45 | 1895 |
| 1397772 | N/A | N/A | 282310 | 282329 | CTCTCATAGTCTTAATTCCC | 30 | 1896 |
| 1397799 | N/A | N/A | 24779 | 24798 | GCTGAACTCTTTGACTTATT | 40 | 1897 |
| 1397804 | N/A | N/A | 68171 | 68190 | GCACTCCCTCACCTCGCCCT | 77 | 1898 |
| 1397809 | N/A | N/A | 11722 | 11741 | CCACGGCTACAGATCACACC | 49 | 1899 |
| 1397833 | N/A | N/A | 193136 | 193155 | ATGCCACTACATGCAGGGTC | 149 | 1900 |
| 1397837 | N/A | N/A | 165177 | 165196 | ATTGCCTCATACTTGTTGGT | 117 | 1901 |
| 1397867 | N/A | N/A | 224106 | 224125 | CCCCACTTTCATCACTTTAC | 70 | 1902 |
| 1397963 | N/A | N/A | 96462 | 96481 | ATGCATCCATCAATACTGTA | 85 | 1903 |
| 1397981 | N/A | N/A | 28034 | 28053 | ATGCTCTCATAATATCCTCA | 48 | 1904 |
| 1397987 | N/A | N/A | 46438 | 46457 | CATCACTGTCTATATCTCTA | 80 | 1905 |
| 1398047 | N/A | N/A | 159562 | 159581 | ATTGCATTCATTCTATTTGG | 36 | 1906 |
| 1398050 | N/A | N/A | 233436 | 233455 | GTTCACCTTTTAATCTACAA | 50 | 1907 |
| 1398063 | N/A | N/A | 259979 | 259998 | TAGGGCTCCCTCCTGATCCA | 72 | 1908 |
| 1398099 | N/A | N/A | 18360 | 18379 | GCTGTTTTAAAACCATGCTT | 48 | 1909 |
| 1398102 | N/A | N/A | 179240 | 179259 | GCTTACCTTCTAGTTCAGCT | 39 | 1910 |
| 1398123 | N/A | N/A | 128283 | 128302 | CCATATGTGACACTCCAGCA | 92 | 1911 |
| 1398181 | N/A | N/A | 19721 | 19740 | GTACATGTTTACATACCCAT | 41 | 1912 |
| 1398190 | N/A | N/A | 93615 | 93634 | GCAGGTGATTCCTAAGATTC | 75 | 1913 |
| 1398204 | N/A | N/A | 37442 | 37461 | ATCTTTGGTAACCATGCCCA | 39 | 1914 |
| 1398234 | N/A | N/A | 22219 | 22238 | GCAGCAACACTCACTCACCC | 53 | 1915 |
| 1398248 | N/A | N/A | 33771 | 33790 | GCTGGCTCCAATCATTGTCA | 89 | 1916 |
| 1398266 | 662 | 681 | 122967 | 122986 | TCTGTGTCTGCTCCGCCCCA | 14 | 1917 |
| 1398308 | N/A | N/A | 101593 | 101612 | GTAAGCTCTCCTCACACTGT | 133 | 1918 |

TABLE 25-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398387 | N/A | N/A | 52901 | 52920 | GATCATGTGACACTCGCACT | 69 | 1919 |
| 1398389 | N/A | N/A | 222019 | 222038 | CTGTAGCTTTGACACTAGCA | 73 | 1920 |
| 1398423 | 2480 | 2499 | 292464 | 292483 | TCTACTTGTGTTACAGCACA | 50 | 1921 |
| 1398475 | N/A | N/A | 289154 | 289173 | ACTGGCTGTCAACAATCATT | 175 | 1922 |
| 1398521 | N/A | N/A | 171301 | 171320 | GCACAGAATCCCTTCACCCC | 40 | 1923 |
| 1398546 | N/A | N/A | 269317 | 269336 | GTCTACATCTATCTGGGCTT | 64 | 1924 |
| 1398623 | N/A | N/A | 39417 | 39436 | TTTCCTGACATCCAACCCTC | 81 | 1925 |
| 1398659 | N/A | N/A | 209417 | 209436 | TGGTTTTAATTCTCTCATCA | 74 | 1926 |
| 1398678 | N/A | N/A | 104225 | 104244 | TATATATTTCAGGCATTTTC | 43 | 1927 |
| 1398686 | N/A | N/A | 15029 | 15048 | CTTTCTATTTACTCACAGCC | 86 | 1928 |
| 1398691 | N/A | N/A | 98577 | 98596 | GCCACTGATTATAATACTTT | 85 | 1929 |
| 1398694 | N/A | N/A | 176671 | 176690 | GCAGCATCCTCCTCCCCTCT | 121 | 1930 |
| 1398696 | N/A | N/A | 49915 | 49934 | GACTCTCTCACTCCCACATA | 86 | 1931 |
| 1398701 | N/A | N/A | 8524 | 8543 | ACAGAATTTATGCCCATGCA | 47 | 1932 |
| 1398704 | N/A | N/A | 90069 | 90088 | CACCCATGCTATTAGAGCTC | 29 | 1933 |
| 1398713 | N/A | N/A | 121037 | 121056 | TGAATCTAGTTCAACTGGCC | 113 | 1934 |
| 1398714 | N/A | N/A | 32087 | 32106 | GTGGAAGGCCCTCAACCTGC | 78 | 1935 |
| 1398715 | N/A | N/A | 104616 | 104635 | TCCTTCCCATAGTTCCTCTC | 93 | 1936 |
| 1398730 | N/A | N/A | 134563 | 134582 | ATGCTACGCTTACAATAGCA | 86 | 1937 |
| 1398754 | N/A | N/A | 105170 | 105189 | CAGACATATCATCCATGCCT | 90 | 1938 |
| 1398763 | N/A | N/A | 216488 | 216507 | AAGGTCTTAGAAATCTCTCT | 125 | 1939 |
| 1398822 | N/A | N/A | 88414 | 88433 | CCATCCTCATCGCCATCTTT | 68 | 1940 |
| 1398856 | N/A | N/A | 13276 | 13295 | TGCCACTAAATTTAATTCCA | 36 | 1941 |
| 1398882 | N/A | N/A | 47557 | 47576 | GTACGGCCAATCTCCAGTCA | 59 | 1942 |
| 1398902 | N/A | N/A | 50888 | 50907 | CCTTTCTATTTTTAGCAGAT | 64 | 1943 |
| 1398938 | N/A | N/A | 57386 | 57405 | GCTTGGCAGCATTCCTCCCC | 92 | 1944 |
| 1398950 | N/A | N/A | 6512 | 6531 | GCACTTCTCACTGATAGTTT | 28 | 1945 |
| 1398958 | N/A | N/A | 65806 | 65825 | ACCTCAATTTCCTCACTGCC | 126 | 1946 |
| 1399013 | N/A | N/A | 154518 | 154537 | TCCCTCTTACTCTCGGAGGC | 45 | 1947 |
| 1399066 | N/A | N/A | 103085 | 103104 | TCATCCTCTTTTATCACTAC | 89 | 1948 |
| 1399098 | N/A | N/A | 80832 | 80851 | CCCATGGCTTTTTCCTATA | 118 | 1949 |
| 1399128 | 2024 | 2043 | 276354 | 276373 | TTCACTTCAGAGATCTCCTC | 98 | 1950 |
| 1399192 | N/A | N/A | 206434 | 206453 | GCTAAGGTTTTCCAAACCTA | 55 | 1951 |
| 1399200 | N/A | N/A | 244582 | 244601 | ATGGTTTTATTCTTACAGCA | 50 | 1952 |
| 1399230 | N/A | N/A | 31641 | 31660 | GCTGCTGGCTCACTGCAGAA | 74 | 1953 |
| 1399240 | N/A | N/A | 10418 | 10437 | CCTCACTGTATCTACTGTAA | 57 | 1954 |

TABLE 25-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1399319 | N/A | N/A | 35860 | 35879 | CTGCATCAAATCCTTTCAGA | 48 | 1955 |
| 1399471 | N/A | N/A | 184709 | 184728 | ATGCACTGATTTCCCTCATT | 53 | 1956 |
| 1399496 | N/A | N/A | 84848 | 84867 | CCTTATTTACAACCTGCCTA | 111 | 1957 |
| 1399506 | N/A | N/A | 29639 | 29658 | CTGCCTTTCTGATAAAGCTA | 52 | 1958 |

TABLE 26

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 21 | 178 |
| 1394453 | 2481 | 2500 | 292465 | 292484 | ATCTACTTGTGTTACAGCAC | 52 | 1959 |
| 1394555 | 663 | 682 | 122968 | 122987 | GTCTGTGTCTGCTCCGCCCC | 25† | 1960 |
| 1397570 | N/A | N/A | 285602 | 285621 | TGTTCAGGTTCTACCATCCC | 52 | 1961 |
| 1397585 | N/A | N/A | 260048 | 260067 | TCCCCAGCTTTGACTTCTCC | 98 | 1962 |
| 1397593 | N/A | N/A | 96469 | 96488 | ATTTTCTATGCATCCATCAA | 74 | 1963 |
| 1397599 | N/A | N/A | 42543 | 42562 | ACTCAGTCAGTCACTCATAT | 55 | 1964 |
| 1397609 | N/A | N/A | 6683 | 6702 | ACTAAACCTTACATTCTGGA | 69 | 1965 |
| 1397617 | N/A | N/A | 269543 | 269562 | CTGTTGTGTTACTTTAGCCA | 39 | 1966 |
| 1397659 | N/A | N/A | 53070 | 53089 | CTGCAATCACACTCCATCAA | 72 | 1967 |
| 1397666 | N/A | N/A | 91246 | 91265 | GAGCTGAAATCCCATCCCCT | 81 | 1968 |
| 1397680 | N/A | N/A | 206768 | 206787 | GCTCAATTAAACTGATAGCC | 44 | 1969 |
| 1397703 | 2031 | 2050 | 276361 | 276380 | ATCCATCTTCACTTCAGAGA | 92 | 1970 |
| 1397739 | N/A | N/A | 101595 | 101614 | CTGTAAGCTCTCCTCACACT | 74 | 1971 |
| 1397771 | N/A | N/A | 11723 | 11742 | GCCACGGCTACAGATCACAC | 61 | 1972 |
| 1397784 | N/A | N/A | 103086 | 103105 | GTCATCCTCTTTTATCACTA | 45 | 1973 |
| 1397797 | N/A | N/A | 8656 | 8675 | ACACACTGTTTCAAGCATTT | 45 | 1974 |
| 1397801 | N/A | N/A | 15905 | 15924 | TTTGTTCCATCACTCTAGCT | 80 | 1975 |
| 1397816 | N/A | N/A | 154525 | 154544 | CAGAAGTTCCCTCTTACTCT | 46 | 1976 |
| 1397839 | N/A | N/A | 179243 | 179262 | CTTGCTTACCTTCTAGTTCA | 48 | 1977 |
| 1397856 | N/A | N/A | 32243 | 32262 | TGGTACTTTTCTATCGGTTC | 21 | 1978 |
| 1397868 | N/A | N/A | 158124 | 158143 | TGCGATCCTCAACTCTACTT | 51 | 1979 |
| 1397900 | N/A | N/A | 26937 | 26956 | CCATTGACCTATCTATGCAT | 75 | 1980 |
| 1397927 | N/A | N/A | 22951 | 22970 | TGGACTCCACGACCTTACAC | 72 | 1981 |
| 1397956 | N/A | N/A | 104227 | 104246 | TCTATATATTTCAGGCATTT | 56 | 1982 |
| 1397965 | N/A | N/A | 134832 | 134851 | GCCCTTTCCTTCATGATGTC | 65 | 1983 |

TABLE 26-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1397977 | N/A | N/A | 31674 | 31693 | CACTCGATCTTTCTAGGCTC | 52 | 1984 |
| 1398027 | N/A | N/A | 282633 | 282652 | GCAACTTCCTACTTCTATTT | 74 | 1985 |
| 1398036 | N/A | N/A | 88415 | 88434 | TCCATCCTCATCGCCATCTT | 50 | 1986 |
| 1398061 | N/A | N/A | 184710 | 184729 | CATGCACTGATTTCCCTCAT | 52 | 1987 |
| 1398071 | N/A | N/A | 245283 | 245302 | CTGCATGTCTTCTACAAACA | 53 | 1988 |
| 1398119 | N/A | N/A | 68178 | 68197 | GCATGATGCACTCCCTCACC | 71 | 1989 |
| 1398127 | N/A | N/A | 15030 | 15049 | CCTTTCTATTTACTCACAGC | 69 | 1990 |
| 1398137 | N/A | N/A | 272497 | 272516 | GCTCTTGCTATAATAGTTCA | 59 | 1991 |
| 1398142 | N/A | N/A | 190063 | 190082 | CCCATTTCTTTTTCAGATCA | 59 | 1992 |
| 1398164 | N/A | N/A | 30069 | 30088 | CTCCCTGTATTAATCTGATC | 95 | 1993 |
| 1398179 | N/A | N/A | 19821 | 19840 | GCACACACACAATAAGCCTT | 67 | 1994 |
| 1398188 | N/A | N/A | 93677 | 93696 | GGTCTAACTCAAATAGTGCT | 42 | 1995 |
| 1398206 | N/A | N/A | 98578 | 98597 | AGCCACTGATTATAATACTT | 73 | 1996 |
| 1398210 | N/A | N/A | 233534 | 233553 | TCCTTATCATGACAAGGCAT | 41 | 1997 |
| 1398216 | N/A | N/A | 86865 | 86884 | TCTACATACTCTACCAGGTT | 45 | 1998 |
| 1398221 | N/A | N/A | 105171 | 105190 | TCAGACATATCATCCATGCC | 80 | 1999 |
| 1398277 | N/A | N/A | 22220 | 22239 | GGCAGCAACACTCACTCACC | 55 | 2000 |
| 1398312 | N/A | N/A | 121395 | 121414 | GCAGAGGTTAACCAAGTGCT | 71 | 2001 |
| 1398332 | N/A | N/A | 165372 | 165391 | ATGGCTTACAAAATTCCTCT | 32 | 2002 |
| 1398341 | N/A | N/A | 81766 | 81785 | CTGCCTTGTTTACCTCACCT | 83 | 2003 |
| 1398386 | N/A | N/A | 24826 | 24845 | GCTTGCTTACTTAGGAGGCT | 32 | 2004 |
| 1398415 | N/A | N/A | 51069 | 51088 | GTTCTTGTCTCTCATATGTA | 57 | 2005 |
| 1398496 | N/A | N/A | 39711 | 39730 | AGATTACACATCCCACAGGC | 47 | 2006 |
| 1398497 | N/A | N/A | 113837 | 113856 | GCTACTCTTCATCATTCACT | 95 | 2007 |
| 1398518 | N/A | N/A | 222030 | 222049 | GCAAACCACTTCTGTAGCTT | 15 | 2008 |
| 1398532 | N/A | N/A | 28048 | 28067 | AGTTGATACAAATAATGCTC | 27 | 2009 |
| 1398572 | N/A | N/A | 7693 | 7712 | TCCCCTGCCACCTTCTGTCT | 79 | 2010 |
| 1398586 | N/A | N/A | 13356 | 13375 | TGTCACACTAAACACTAGCT | 43 | 2011 |
| 1398595 | N/A | N/A | 49916 | 49935 | TGACTCTCTCACTCCCACAT | 83 | 2012 |
| 1398672 | N/A | N/A | 176810 | 176829 | GCCCAACATCTCAAGCTGTC | 49 | 2013 |
| 1398684 | N/A | N/A | 18510 | 18529 | GGTCCTATTATACCTCTACT | 49 | 2014 |
| 1398709 | N/A | N/A | 209703 | 209722 | CTCCATGTACTTCCTCTAAC | 67 | 2015 |
| 1398717 | N/A | N/A | 57913 | 57932 | TGCCACTGACATCATAAAAC | 87 | 2016 |
| 1398755 | N/A | N/A | 84849 | 84868 | TCCTTATTTACAACCTGCCT | 67 | 2017 |
| 1398805 | N/A | N/A | 65903 | 65922 | TGGGATCTAAGACCCTTACA | 84 | 2018 |
| 1398828 | N/A | N/A | 146927 | 146946 | GGACTTTTTTCTTCTTGCTA | 64 | 2019 |

TABLE 26-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398883 | N/A | N/A | 217168 | 217187 | AGGAGCCATCTCCCTGCCAT | 113 | 2020 |
| 1398972 | N/A | N/A | 264465 | 264484 | GAAGTACTTAATCAAGGGCT | 66 | 2021 |
| 1398986 | N/A | N/A | 46446 | 46465 | GTCTAATCCATCACTGTCTA | 68 | 2022 |
| 1398997 | N/A | N/A | 159564 | 159583 | GTATTGCATTCATTCTATTT | 53 | 2023 |
| 1399020 | N/A | N/A | 47558 | 47577 | TGTACGGCCAATCTCCAGTC | 53 | 2024 |
| 1399061 | N/A | N/A | 104621 | 104640 | ACTCATCCTTCCCATAGTTC | 73 | 2025 |
| 1399115 | N/A | N/A | 10423 | 10442 | TCACTCCTCACTGTATCTAC | 61 | 2026 |
| 1399120 | N/A | N/A | 35893 | 35912 | TTTCTCTCTGTATACTGGTT | 55 | 2027 |
| 1399123 | N/A | N/A | 289167 | 289186 | CATCTACCATCACACTGGCT | 88 | 2028 |
| 1399175 | N/A | N/A | 90197 | 90216 | GCCCACTCATAAGCCATAAC | 41 | 2029 |
| 1399217 | N/A | N/A | 224109 | 224128 | CCACCCCACTTTCATCACTT | 64 | 2030 |
| 1399249 | N/A | N/A | 37457 | 37476 | ACACCTCTAGAATTCATCTT | 79 | 2031 |
| 1399274 | N/A | N/A | 129754 | 129773 | GCTGTAATGCACCATACTCA | 76 | 2032 |
| 1399292 | N/A | N/A | 33848 | 33867 | CTTCACAGTACTCACTTACA | 80 | 2033 |
| 1399310 | N/A | N/A | 171302 | 171321 | GGCACAGAATCCCTTCACCC | 50 | 2034 |
| 1399439 | N/A | N/A | 193425 | 193444 | GCACATTATATTCCAGAGCC | 47 | 2035 |

TABLE 27

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 21 | 178 |
| 1397555 | 2482 | 2501 | 292466 | 292485 | CATCTACTTGTGTTACAGCA | 47 | 2036 |
| 1397568 | N/A | N/A | 70128 | 70147 | TCTCACAACACTTTGGGTCT | 83 | 2037 |
| 1397575 | N/A | N/A | 103087 | 103106 | AGTCATCCTCTTTTATCACT | 66 | 2038 |
| 1397576 | N/A | N/A | 7703 | 7722 | GCTCATTCCTTCCCCTGCCA | 49 | 2039 |
| 1397598 | N/A | N/A | 171560 | 171579 | CCCAGAGCTTACCTTCAGTT | 66 | 2040 |
| 1397601 | N/A | N/A | 28093 | 28112 | TCAGCATAATATTCTACTGT | 31 | 2041 |
| 1397605 | N/A | N/A | 49919 | 49938 | GCCTGACTCTCTCACTCCCA | 80 | 2042 |
| 1397640 | N/A | N/A | 121662 | 121681 | CACCACTCCCTCAAGCTGTA | 82 | 2043 |
| 1397647 | N/A | N/A | 222031 | 222050 | AGCAAACCACTTCTGTAGCT | 39 | 2044 |
| 1397657 | N/A | N/A | 6843 | 6862 | GTAACATATTTACTCAGTAT | 28 | 2045 |
| 1397749 | N/A | N/A | 134848 | 134867 | CTGTAAGTGCAATACTGCCC | 66 | 2046 |
| 1397767 | N/A | N/A | 233549 | 233568 | GTTCCTTTTCACCTATCCTT | 39 | 2047 |

TABLE 27-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1397789 | N/A | N/A | 88420 | 88439 | GTTTTTCCATCCTCATCGCC | 45 | 2048 |
| 1397806 | N/A | N/A | 104228 | 104247 | GTCTATATATTTCAGGCATT | 33 | 2049 |
| 1397807 | N/A | N/A | 113907 | 113926 | TCCCCAGTATCTATCTCATC | 86 | 2050 |
| 1397811 | N/A | N/A | 42614 | 42633 | GCAACCATTTTATTGTTCAC | 32 | 2051 |
| 1397812 | N/A | N/A | 53074 | 53093 | GCTACTGCAATCACACTCCA | 72 | 2052 |
| 1397814 | N/A | N/A | 265092 | 265111 | CGGGTCTGTATCATTCAGGA | 41 | 2053 |
| 1397844 | N/A | N/A | 51092 | 51111 | TCGGATATTTGACATTTACT | 55 | 2054 |
| 1397858 | N/A | N/A | 26938 | 26957 | CCCATTGACCTATCTATGCA | 68 | 2055 |
| 1397874 | N/A | N/A | 19157 | 19176 | CAGAAACTATGATTCTCTTC | 86 | 2056 |
| 1397887 | N/A | N/A | 8676 | 8695 | GGTTACATATATATTAACTC | 28 | 2057 |
| 1397901 | N/A | N/A | 22952 | 22971 | ATGGACTCCACGACCTTACA | 55 | 2058 |
| 1397909 | N/A | N/A | 194107 | 194126 | TCAAGGTTTCTATCCAGCTT | 98 | 2059 |
| 1397932 | N/A | N/A | 207006 | 207025 | TGTTGAACATTTATTGCTCT | 51 | 2060 |
| 1397979 | N/A | N/A | 105181 | 105200 | GCTTTCTCACTCAGACATAT | 74 | 2061 |
| 1398013 | N/A | N/A | 165400 | 165419 | CCATTGGTATTTCAAGCTAC | 31 | 2062 |
| 1398041 | N/A | N/A | 47772 | 47791 | GCTTCTGACTTTACTGCTGT | 71 | 2063 |
| 1398114 | N/A | N/A | 19974 | 19993 | CACCAATCCCACTTCTCCAA | 67 | 2064 |
| 1398165 | N/A | N/A | 65924 | 65943 | CCTCTCCCACTTGCCAGATC | 93 | 2065 |
| 1398183 | N/A | N/A | 81767 | 81786 | ACTGCCTTGTTTACCTCACC | 99 | 2066 |
| 1398273 | N/A | N/A | 190064 | 190083 | TCCCATTTCTTTTTCAGATC | 46 | 2067 |
| 1398309 | N/A | N/A | 37468 | 37487 | ACTGGAGTTTTACACCTCTA | 42 | 2068 |
| 1398371 | N/A | N/A | 12012 | 12031 | CCATCTTTATTCTATGAGCC | 30 | 2069 |
| 1398400 | N/A | N/A | 30117 | 30136 | TCAACCTCACCCCTATTGTT | 93 | 2070 |
| 1398413 | N/A | N/A | 22305 | 22324 | TCACTTTCTTACATGCGGTT | 39 | 2071 |
| 1398491 | N/A | N/A | 129869 | 129888 | TTGCTGTGTTCCCAAAGTAC | 71 | 2072 |
| 1398520 | N/A | N/A | 36032 | 36051 | ACTCATCTTCTACTGCAGTA | 76 | 2073 |
| 1398523 | N/A | N/A | 101631 | 101650 | ACATTCTCTTCTTCCTAGTT | 61 | 2074 |
| 1398570 | 2035 | 2054 | 276365 | 276384 | CTGCATCCATCTTCACTTCA | 65 | 2075 |
| 1398574 | N/A | N/A | 179248 | 179267 | ACAGGCTTGCTTACCTTCTA | 66 | 2076 |
| 1398583 | N/A | N/A | 285649 | 285668 | GTGCTCTCTCACCTGGGAAC | 61 | 2077 |
| 1398593 | N/A | N/A | 31676 | 31695 | CTCACTCGATCTTTCTAGGC | 49 | 2078 |
| 1398632 | N/A | N/A | 274132 | 274151 | CGGGCTTTAATTTCCTTTCA | 55 | 2079 |
| 1398700 | N/A | N/A | 91248 | 91267 | CTGAGCTGAAATCCCATCCC | 82 | 2080 |
| 1398728 | N/A | N/A | 217903 | 217922 | GTCCTTCTCTTTTCGCACCC | 78 | 2081 |

TABLE 27-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398734 | N/A | N/A | 269553 | 269572 | GCATCCACATCTGTTGTGTT | 56 | 2082 |
| 1398749 | N/A | N/A | 185049 | 185068 | GCTTGTCACAATACTGCCAC | 40 | 2083 |
| 1398769 | N/A | N/A | 24843 | 24862 | ATCAATTGCATTCCAAGGCT | 54 | 2084 |
| 1398784 | N/A | N/A | 15060 | 15079 | GCGGAATTCCTCAAGGCACA | 33 | 2085 |
| 1398831 | N/A | N/A | 94190 | 94209 | TGTTTCTCCCTATATACACT | 48 | 2086 |
| 1398861 | N/A | N/A | 245348 | 245367 | TGGATGTCTTCCTCTGGTTC | 54 | 2087 |
| 1398875 | N/A | N/A | 154561 | 154580 | ATGTCATGCTCTCCATGGAA | 43 | 2088 |
| 1398890 | N/A | N/A | 209704 | 209723 | CCTCCATGTACTTCCTCTAA | 75 | 2089 |
| 1398911 | N/A | N/A | 33852 | 33871 | CCAACTTCACAGTACTCACT | 60 | 2090 |
| 1398928 | N/A | N/A | 15906 | 15925 | CTTTGTTCCATCACTCTAGC | 55 | 2091 |
| 1398929 | N/A | N/A | 158125 | 158144 | TTGCGATCCTCAACTCTACT | 34 | 2092 |
| 1398970 | N/A | N/A | 39714 | 39733 | TGGAGATTACACATCCCACA | 33 | 2093 |
| 1398989 | N/A | N/A | 84850 | 84869 | ATCCTTATTTACAACCTGCC | 73 | 2094 |
| 1399001 | 664 | 683 | 122969 | 122988 | AGTCTGTGTCTGCTCCGCCC | 10† | 2095 |
| 1399014 | N/A | N/A | 46447 | 46466 | GGTCTAATCCATCACTGTCT | 50 | 2096 |
| 1399032 | N/A | N/A | 57967 | 57986 | GTCTATGCTTTTCTAAGACT | 84 | 2097 |
| 1399077 | N/A | N/A | 96471 | 96490 | TCATTTTCTATGCATCCATC | 52 | 2098 |
| 1399089 | N/A | N/A | 177018 | 177037 | CTTCCACTGCACCTAGCCCT | 84 | 2099 |
| 1399124 | N/A | N/A | 86866 | 86885 | CTCTACATACTCTACCAGGT | 42 | 2100 |
| 1399132 | N/A | N/A | 260250 | 260269 | CTGTTTCGCATACACAGTAC | 77 | 2101 |
| 1399166 | N/A | N/A | 289172 | 289191 | AGGCACATCTACCATCACAC | 57 | 2102 |
| 1399182 | N/A | N/A | 10431 | 10450 | CATCTTAATCACTCCTCACT | 89 | 2103 |
| 1399276 | N/A | N/A | 32244 | 32263 | TTGGTACTTTTCTATCGGTT | 30 | 2104 |
| 1399287 | N/A | N/A | 90260 | 90279 | TCACCTATCATCTAGGACCT | 63 | 2105 |
| 1399347 | N/A | N/A | 224562 | 224581 | TAGCTTGATCAATCACAGCT | 47 | 2106 |
| 1399360 | N/A | N/A | 13372 | 13391 | GGCCAATTTTGATCCTTGTC | 35 | 2107 |
| 1399370 | N/A | N/A | 148175 | 148194 | AAGTTCTTATTACCATAGCT | 69 | 2108 |
| 1399381 | N/A | N/A | 159588 | 159607 | GCTACTCTGATTTACTTCAA | 55 | 2109 |
| 1399433 | N/A | N/A | 283633 | 283652 | GCCTGTCCTCTTCTAATCAA | 85 | 2110 |
| 1399464 | N/A | N/A | 104646 | 104665 | CCAGTAAACCACTTTCTGGC | 89 | 2111 |
| 1399504 | N/A | N/A | 98602 | 98621 | TGTTTCCTCTTATCAGGCCC | 47 | 2112 |

TABLE 28

Reduction of APP RNA by 5-10-5 MOE gapmers with mixed PO/PS internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 19 | 178 |
| 1397528 | N/A | N/A | 101638 | 101657 | TTATTTCACATTCTCTTCTT | 84 | 2113 |
| 1397653 | N/A | N/A | 88489 | 88508 | GCACCAATTCTCTAGCACAC | 54 | 2114 |
| 1397762 | N/A | N/A | 26939 | 26958 | CCCCATTGACCTATCTATGC | 47 | 2115 |
| 1397764 | N/A | N/A | 6889 | 6908 | TCTCATCCCATTGTTCCTTA | 32 | 2116 |
| 1397796 | N/A | N/A | 283635 | 283654 | CTGCCTGTCCTCTTCTAATC | 83 | 2117 |
| 1397838 | N/A | N/A | 274165 | 274184 | GCTAGGGCTTTCTTTTCTCA | 40 | 2118 |
| 1397870 | N/A | N/A | 58436 | 58455 | AGCGCAGCCACTCCCTGGCA | 92 | 2119 |
| 1397880 | N/A | N/A | 38261 | 38280 | TCTCTCATCATCCCAGATCT | 67 | 2120 |
| 1397916 | N/A | N/A | 90261 | 90280 | CTCACCTATCATCTAGGACC | 43 | 2121 |
| 1397939 | N/A | N/A | 30123 | 30142 | TGGATTTCAACCTCACCCCT | 81 | 2122 |
| 1397941 | N/A | N/A | 158141 | 158160 | GGCAACACAATCTCTTTTGC | 29 | 2123 |
| 1397962 | N/A | N/A | 31679 | 31698 | GCCCTCACTCGATCTTTCTA | 86 | 2124 |
| 1397983 | N/A | N/A | 7707 | 7726 | GTGTGCTCATTCCTTCCCCT | 24 | 2125 |
| 1397992 | N/A | N/A | 86870 | 86889 | CATGCTCTACATACTCTACC | 38 | 2126 |
| 1397995 | N/A | N/A | 234374 | 234393 | CCAAGTTCATTCCCCTAGCC | 66 | 2127 |
| 1398007 | N/A | N/A | 222034 | 222053 | CCCAGCAAACCACTTCTGTA | 58 | 2128 |
| 1398035 | N/A | N/A | 98615 | 98634 | GCTGCACAATTATTGTTTCC | 42 | 2129 |
| 1398062 | N/A | N/A | 53075 | 53094 | TGCTACTGCAATCACACTCC | 66 | 2130 |
| 1398072 | N/A | N/A | 22306 | 22325 | CTCACTTTCTTACATGCGGT | 13 | 2131 |
| 1398090 | N/A | N/A | 179400 | 179419 | AGAGCTTTTTCTATCTCCTT | 29 | 2132 |
| 1398126 | N/A | N/A | 39715 | 39734 | TTGGAGATTACACATCCCAC | 58 | 2133 |
| 1398129 | N/A | N/A | 10432 | 10451 | CCATCTTAATCACTCCTCAC | 52 | 2134 |
| 1398138 | N/A | N/A | 33853 | 33872 | GCCAACTTCACAGTACTCAC | 34 | 2135 |
| 1398147 | N/A | N/A | 134893 | 134912 | ACCCAATGTCTTTTTAGGCA | 24 | 2136 |
| 1398151 | 2483 | 2502 | 292467 | 292486 | GCATCTACTTGTGTTACAGC | 33 | 2137 |
| 1398171 | N/A | N/A | 260299 | 260318 | TGTGGTATCTACTATCACTT | 78 | 2138 |
| 1398172 | N/A | N/A | 96472 | 96491 | CTCATTTTCTATGCATCCAT | 36 | 2139 |
| 1398195 | N/A | N/A | 51401 | 51420 | GCCTGCCGTTACCAATGCCA | 54 | 2140 |
| 1398197 | N/A | N/A | 49920 | 49939 | GGCCTGACTCTCTCACTCCC | 71 | 2141 |
| 1398201 | N/A | N/A | 36034 | 36053 | AAACTCATCTTCTACTGCAG | 66 | 2142 |
| 1398214 | N/A | N/A | 186344 | 186363 | CTTCCAAATATACAGTGGCA | 44 | 2143 |
| 1398250 | 665 | 684 | 122970 | 122989 | TAGTCTGTGTCTGCTCCGCC | 28† | 2144 |
| 1398274 | N/A | N/A | 148301 | 148320 | TGCCCATCATCCATCCCTGC | 75 | 2145 |
| 1398283 | N/A | N/A | 12013 | 12032 | TCCATCTTTATTCTATGAGC | 25 | 2146 |
| 1398342 | N/A | N/A | 289342 | 289361 | GCATCATTTTTGCTCCCCAT | 52 | 2147 |
| 1398366 | N/A | N/A | 94193 | 94212 | GTCTGTTTCTCCCTATATAC | 40 | 2148 |

TABLE 28-continued

Reduction of APP RNA by 5-10-5 MOE gapmers with mixed PO/PS internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398378 | N/A | N/A | 177114 | 177133 | GCCTTTGTTTTTAATCCAA | 27 | 2149 |
| 1398379 | N/A | N/A | 84878 | 84897 | GTCCACAATCTCCACAGACA | 27 | 2150 |
| 1398404 | N/A | N/A | 246008 | 246027 | GTGCTGATCTGATTTCCAAC | 38 | 2151 |
| 1398410 | N/A | N/A | 217904 | 217923 | GGTCCTTCTCTTTTCGCACC | 44 | 2152 |
| 1398449 | N/A | N/A | 121663 | 121682 | ACACCACTCCCTCAAGCTGT | 90 | 2153 |
| 1398482 | N/A | N/A | 15061 | 15080 | TGCGGAATTCCTCAAGGCAC | 36 | 2154 |
| 1398492 | N/A | N/A | 42615 | 42634 | TGCAACCATTTTATTGTTCA | 33 | 2155 |
| 1398495 | N/A | N/A | 285928 | 285947 | CATCATGACTTCTTCAGGCA | 52 | 2156 |
| 1398513 | N/A | N/A | 20041 | 20060 | TCATCCATCATGCATGCTTC | 34 | 2157 |
| 1398544 | N/A | N/A | 114470 | 114489 | TGCCACCACCCTCAATACTT | 87 | 2158 |
| 1398582 | N/A | N/A | 190155 | 190174 | TGTTCCTTCTTACATTGGCA | 42 | 2159 |
| 1398695 | N/A | N/A | 165667 | 165686 | GTGGTTTTTCCTCAACCTTT | 35 | 2160 |
| 1398708 | N/A | N/A | 65940 | 65959 | GACTCATTTCTACCTCCCTC | 66 | 2161 |
| 1398742 | N/A | N/A | 269905 | 269924 | CCTGTTCTTTGACTATCGCC | 66 | 2162 |
| 1398783 | N/A | N/A | 154590 | 154609 | ACCCACCCACACTTTTGGCT | 66 | 2163 |
| 1398811 | N/A | N/A | 104229 | 104248 | GGTCTATATATTTCAGGCAT | 30 | 2164 |
| 1398815 | N/A | N/A | 104652 | 104671 | AGCACTCCAGTAAACCACTT | 69 | 2165 |
| 1398837 | N/A | N/A | 130143 | 130162 | TCTCACTTTATCCATTCATA | 41 | 2166 |
| 1398845 | N/A | N/A | 19182 | 19201 | GAGGTCTTATAGATTCTACC | 37 | 2167 |
| 1398864 | N/A | N/A | 72332 | 72351 | CCACAATGCTTTTCACACTA | 70 | 2168 |
| 1398948 | N/A | N/A | 23266 | 23285 | ATGGTTGTATCCCAATGCTT | 12 | 2169 |
| 1398949 | N/A | N/A | 91249 | 91268 | CCTGAGCTGAAATCCCATCC | 60 | 2170 |
| 1398955 | N/A | N/A | 159666 | 159685 | GTCCATTACAAACAAGTAAC | 24 | 2171 |
| 1398981 | N/A | N/A | 24930 | 24949 | CAGCATTCAGAACTTCCTGC | 42 | 2172 |
| 1399027 | N/A | N/A | 46451 | 46470 | ACAGGGTCTAATCCATCACT | 44 | 2173 |
| 1399034 | N/A | N/A | 28139 | 28158 | TTAGATATTTCTATACATCA | 42 | 2174 |
| 1399047 | N/A | N/A | 265210 | 265229 | TGCTCATACTATACCTCTGA | 44 | 2175 |
| 1399053 | 2038 | 2057 | 276368 | 276387 | ATTCTGCATCCATCTTCACT | 111 | 2176 |
| 1399076 | N/A | N/A | 8699 | 8718 | ACAGTGCTTATGCTATGCCA | 23 | 2177 |
| 1399101 | N/A | N/A | 194108 | 194127 | CTCAAGGTTTCTATCCAGCT | 120 | 2178 |
| 1399112 | N/A | N/A | 47912 | 47931 | GGGAAAGATTTACATTCTAC | 43 | 2179 |
| 1399113 | N/A | N/A | 171570 | 171589 | GGTCTCTGCTCCCAGAGCTT | 38 | 2180 |
| 1399129 | N/A | N/A | 207134 | 207153 | TCCACATCATATAGTGGCGA | 39 | 2181 |
| 1399131 | N/A | N/A | 32282 | 32301 | CTGTATTATTTCTTTTACGC | 38 | 2182 |
| 1399133 | N/A | N/A | 15908 | 15927 | TGCTTTGTTCCATCACTCTA | 49 | 2183 |
| 1399265 | N/A | N/A | 82409 | 82428 | GCTACACCTGATGACAGCAA | 85 | 2184 |

TABLE 28-continued

Reduction of APP RNA by 5-10-5 MOE gapmers with mixed PO/PS internucleoside linkages

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1399313 | N/A | N/A | 105198 | 105217 | TGTCTTCTACTCTTCTTGCT | 72 | 2185 |
| 1399326 | N/A | N/A | 209774 | 209793 | AGTCATCTATCATCTGTTCT | 45 | 2186 |
| 1399356 | N/A | N/A | 103095 | 103114 | TTCAACTTAGTCATCCTCTT | 75 | 2187 |
| 1399395 | N/A | N/A | 225512 | 225531 | GCCATATCTTTCAATCCTGC | 19 | 2188 |
| 1399465 | N/A | N/A | 13493 | 13512 | TAGATTTTCAATTCCTGTCA | 36 | 2189 |

TABLE 29

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 23 | 178 |
| 1396897 | N/A | N/A | 177301 | 177320 | GCACCTTCAGAATTCTCCCT | 40 | 2190 |
| 1397543 | N/A | N/A | 53168 | 53187 | GCTCATACCTCACATGTGGC | 55 | 2191 |
| 1397592 | N/A | N/A | 22309 | 22328 | GCTCTCACTTTCTTACATGC | 37 | 2192 |
| 1397656 | N/A | N/A | 103097 | 103116 | TCTTCAACTTAGTCATCCTC | 65 | 2193 |
| 1397667 | N/A | N/A | 25017 | 25036 | CCACACTCAGAACTTCCTTC | 109 | 2194 |
| 1397692 | N/A | N/A | 65942 | 65961 | GGGACTCATTTCTACCTCCC | 258 | 2195 |
| 1397743 | N/A | N/A | 135854 | 135873 | GAGACATCATACTTTCTAGT | 68 | 2196 |
| 1397750 | N/A | N/A | 283702 | 283721 | GCAGAGGTTTTAATTGCTGA | 84 | 2197 |
| 1397759 | N/A | N/A | 105199 | 105218 | CTGTCTTCTACTCTTCTTGC | 79 | 2198 |
| 1397822 | N/A | N/A | 88490 | 88509 | GGCACCAATTCTCTAGCACA | 85 | 2199 |
| 1397857 | N/A | N/A | 7779 | 7798 | TGCTTTTCTTCTTATACAAC | 58 | 2200 |
| 1397863 | N/A | N/A | 23459 | 23478 | ATCCAGCTCCTCACTGGCTT | 73 | 2201 |
| 1397884 | N/A | N/A | 85004 | 85023 | CCATATATTACATAGATCTC | 141 | 2202 |
| 1397893 | N/A | N/A | 47959 | 47978 | GTACAATCTATATCTCGCCC | 104 | 2203 |
| 1397896 | N/A | N/A | 115707 | 115726 | GAGGGACATACTCCTCAGCA | 148 | 2204 |
| 1397973 | N/A | N/A | 8746 | 8765 | ACCCATTGTACATCAACATC | 94 | 2205 |
| 1397974 | N/A | N/A | 90262 | 90281 | TCTCACCTATCATCTAGGAC | 42 | 2206 |
| 1398003 | N/A | N/A | 73312 | 73331 | GCTCAACTCATCTAACAGGC | 87 | 2207 |
| 1398008 | N/A | N/A | 285929 | 285948 | TCATCATGACTTCTTCAGGC | 57 | 2208 |
| 1398010 | N/A | N/A | 30124 | 30143 | CTGGATTTCAACCTCACCCC | 169 | 2209 |
| 1398021 | N/A | N/A | 222487 | 222506 | AGGCATGCATTTTAGGGAC | 108 | 2210 |
| 1398046 | N/A | N/A | 195741 | 195760 | GCACCATCCCACTAAGACTC | 79 | 2211 |
| 1398051 | N/A | N/A | 165668 | 165687 | TGTGGTTTTTCCTCAACCTT | 80 | 2212 |
| 1398067 | N/A | N/A | 274765 | 274784 | ATGGTGCTACTTCCCCTTCA | 60 | 2213 |

TABLE 29-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398095 | N/A | N/A | 190207 | 190226 | TGGTGCCTTTACACAGCTGC | 169 | 2214 |
| 1398158 | N/A | N/A | 12020 | 12039 | GTGCTTATCCATCTTTATTC | 50 | 2215 |
| 1398191 | N/A | N/A | 246643 | 246662 | GCCAGAAGTTTCACCAACTC | 94 | 2216 |
| 1398302 | N/A | N/A | 39735 | 39754 | ACTGGATTCTGACACTGTAC | 87 | 2217 |
| 1398352 | N/A | N/A | 28164 | 28183 | TGTTTTCACTTATATCGGTA | 32 | 2218 |
| 1398353 | N/A | N/A | 49921 | 49940 | TGGCCTGACTCTCCACTCC | 87 | 2219 |
| 1398374 | N/A | N/A | 207700 | 207719 | CCTTCCCATTCACTATCTGT | 77 | 2220 |
| 1398392 | N/A | N/A | 32353 | 32372 | AATCAATCACCAATGCTGGC | 94 | 2221 |
| 1398395 | N/A | N/A | 96473 | 96492 | CCTCATTTTCTATGCATCCA | 66 | 2222 |
| 1398411 | N/A | N/A | 234375 | 234394 | ACCAAGTTCATTCCCCTAGC | 194 | 2223 |
| 1398445 | N/A | N/A | 26942 | 26961 | TTGCCCCATTGACCTATCTA | 109 | 2224 |
| 1398456 | N/A | N/A | 159759 | 159778 | GTTCACAGTTTACCCCAAGC | 36 | 2225 |
| 1398486 | N/A | N/A | 43083 | 43102 | ATCTTCCTTAGACTATGCCT | 88 | 2226 |
| 1398526 | N/A | N/A | 36035 | 36054 | GAAACTCATCTTCTACTGCA | 66 | 2227 |
| 1398566 | N/A | N/A | 186345 | 186364 | GCTTCCAAATATACAGTGGC | 54 | 2228 |
| 1398590 | N/A | N/A | 101640 | 101659 | GATTATTTCACATTCTCTTC | 68 | 2229 |
| 1398597 | N/A | N/A | 171691 | 171710 | CCTCTGGTTTTACCAGTACT | 118 | 2230 |
| 1398630 | N/A | N/A | 19227 | 19246 | CCAGATATTACTTTCTTCAT | 85 | 2231 |
| 1398651 | N/A | N/A | 86871 | 86890 | GCATGCTCTACATACTCTAC | 143 | 2232 |
| 1398719 | N/A | N/A | 91386 | 91405 | AGTGAACTAGTTCCTACCTT | 44 | 2233 |
| 1398741 | N/A | N/A | 121796 | 121815 | AGATCAGATTTCTCAACCCC | 101 | 2234 |
| 1398745 | N/A | N/A | 6893 | 6912 | ATGATCTCATCCCATTGTTC | 50 | 2235 |
| 1398761 | N/A | N/A | 13611 | 13630 | TTGCATTTAAATTTTCTGGA | 28 | 2236 |
| 1398762 | N/A | N/A | 15100 | 15119 | ACCTAATTATTTCTCCGTCT | 65 | 2237 |
| 1398807 | N/A | N/A | 180615 | 180634 | CCTCCAGCATATCCTGGGAT | 183 | 2238 |
| 1398910 | N/A | N/A | 15909 | 15928 | TTGCTTTGTTCCATCACTCT | 87 | 2239 |
| 1398918 | N/A | N/A | 38277 | 38296 | GTCCTACCTGCCTTTCTCTC | 120 | 2240 |
| 1398960 | N/A | N/A | 148442 | 148461 | CCAGGTTCCTTCTCCAGGCT | 63 | 2241 |
| 1398984 | 2484 | 2503 | 292468 | 292487 | GGCATCTACTTGTGTTACAG | 42 | 2242 |
| 1398991 | N/A | N/A | 94716 | 94735 | CCTCATCATAACCATTTGTA | 55 | 2243 |
| 1399003 | 2043 | 2062 | 276373 | 276392 | TCGGAATTCTGCATCCATCT | 124 | 2244 |
| 1399068 | N/A | N/A | 83178 | 83197 | CCTGCTCTTATTCCAAGTAA | 86 | 2245 |
| 1399069 | N/A | N/A | 58490 | 58509 | CGGCATCCTCACCTGCATCA | 75 | 2246 |
| 1399122 | N/A | N/A | 31681 | 31700 | CAGCCCTCACTCGATCTTTC | 191 | 2247 |
| 1399135 | N/A | N/A | 158504 | 158523 | GCAAAGATTTGAATCTGGAC | 76 | 2248 |
| 1399140 | N/A | N/A | 10433 | 10452 | ACCATCTTAATCACTCCTCA | 65 | 2249 |

TABLE 29-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1399154 | N/A | N/A | 226487 | 226506 | CCATTCATTTGACAAAGCAT | 121 | 2250 |
| 1399172 | N/A | N/A | 270073 | 270092 | GCAGACTCTCAGTCTTCATC | 125 | 2251 |
| 1399245 | N/A | N/A | 209779 | 209798 | CTAGGAGTCATCTATCATCT | 80 | 2252 |
| 1399263 | N/A | N/A | 265408 | 265427 | CTGTATCTCATTATATGGCT | 30 | 2253 |
| 1399281 | N/A | N/A | 154630 | 154649 | TCCTGATGACTCTACAGCAA | 100 | 2254 |
| 1399286 | N/A | N/A | 260383 | 260402 | GCATACACATTCATCTTGAC | 90 | 2255 |
| 1399294 | N/A | N/A | 20110 | 20129 | ACTCAGTCAACATCCATGCT | 149 | 2256 |
| 1399311 | N/A | N/A | 33855 | 33874 | ATGCCAACTTCACAGTACTC | 84 | 2257 |
| 1399329 | 666 | 685 | 122971 | 122990 | ATAGTCTGTGTCTGCTCCGC | 44† | 2258 |
| 1399369 | N/A | N/A | 46453 | 46472 | GAACAGGGTCTAATCCATCA | 58 | 2259 |
| 1399375 | N/A | N/A | 51577 | 51596 | GTTAAGTTATCATATTGTCT | 176 | 2260 |
| 1399432 | N/A | N/A | 104231 | 104250 | TTGGTCTATATATTTCAGGC | 28 | 2261 |
| 1399451 | N/A | N/A | 218042 | 218061 | GCTGCTTTTCACTTCCACAA | 146 | 2262 |
| 1399462 | N/A | N/A | 104660 | 104679 | TCAGACACAGCACTCCAGTA | 132 | 2263 |
| 1399473 | N/A | N/A | 289345 | 289364 | TGGGCATCATTTTTGCTCCC | 94 | 2264 |
| 1399475 | N/A | N/A | 98616 | 98635 | AGCTGCACAATTATTGTTTC | 88 | 2265 |
| 1399491 | N/A | N/A | 130153 | 130172 | GGGCTGATATTCTCACTTTA | 291 | 2266 |

TABLE 30

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 20 | 178 |
| 1397539 | N/A | N/A | 234724 | 234743 | CCAGCTTTTCCTTTCACATC | 47 | 2267 |
| 1397560 | N/A | N/A | 103102 | 103121 | GCTACTCTTCAACTTAGTCA | 58 | 2268 |
| 1397571 | N/A | N/A | 25019 | 25038 | ATCCACACTCAGAACTTCCT | 97 | 2269 |
| 1397587 | N/A | N/A | 159824 | 159843 | GCATGCTACTACTGAGGCCT | 71 | 2270 |
| 1397600 | N/A | N/A | 36061 | 36080 | GTTCCATCAACAAAGGGCTA | 74 | 2271 |
| 1397604 | N/A | N/A | 85005 | 85024 | ACCATATATTACATAGATCT | 45 | 2272 |
| 1397633 | N/A | N/A | 13698 | 13717 | GCTGCCTTTACATTCAAACA | 114 | 2273 |
| 1397677 | N/A | N/A | 43189 | 43208 | GTAGTAGCCTTCCCTTCCTT | 49 | 2274 |
| 1397718 | N/A | N/A | 207764 | 207783 | AGCATGTATACCATTCAGCA | 74 | 2275 |
| 1397726 | N/A | N/A | 40005 | 40024 | GTCCTTTATAACCCATTGAC | 52 | 2276 |
| 1397795 | N/A | N/A | 222488 | 222507 | AAGGCATGCATTTTTAGGGA | 24 | 2277 |
| 1397829 | N/A | N/A | 10434 | 10453 | AACCATCTTAATCACTCCTC | 44 | 2278 |

TABLE 30-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1397851 | N/A | N/A | 53176 | 53195 | CCGTTCCTGCTCATACCTCA | 80 | 2279 |
| 1397886 | N/A | N/A | 285939 | 285958 | ACCAAAGCTTTCATCATGAC | 73 | 2280 |
| 1397902 | N/A | N/A | 33891 | 33910 | CAGAGTTTCATCTTACCCAA | 76 | 2281 |
| 1397925 | N/A | N/A | 15130 | 15149 | CCTCCTCTATTATAGCCTTT | 85 | 2282 |
| 1397971 | 2047 | 2066 | 276377 | 276396 | CATGTCGGAATTCTGCATCC | 78 | 2283 |
| 1397991 | N/A | N/A | 46463 | 46482 | CTGCAACTATGAACAGGGTC | 90 | 2284 |
| 1397994 | N/A | N/A | 101641 | 101660 | GGATTATTTCACATTCTCTT | 47 | 2285 |
| 1398056 | N/A | N/A | 86872 | 86891 | GGCATGCTCTACATACTCTA | 33 | 2286 |
| 1398096 | 667 | 686 | 122972 | 122991 | CATAGTCTGTGTCTGCTCCG | 59† | 2287 |
| 1398109 | N/A | N/A | 218043 | 218062 | GGCTGCTTTTCACTTCCACA | 59 | 2288 |
| 1398163 | N/A | N/A | 9447 | 9466 | GCCAGTGTATAAACTTGCTC | 41 | 2289 |
| 1398169 | N/A | N/A | 28165 | 28184 | ATGTTTTCACTTATATCGGT | 21 | 2290 |
| 1398178 | N/A | N/A | 7781 | 7800 | TCTGCTTTTCTTCTTATACA | 68 | 2291 |
| 1398184 | N/A | N/A | 196046 | 196065 | GTGGTGGTACTCTACCAACA | 61 | 2292 |
| 1398226 | N/A | N/A | 47960 | 47979 | TGTACAATCTATATCTCGCC | 67 | 2293 |
| 1398268 | N/A | N/A | 83252 | 83271 | CCTCCCCCTATCTCTCACTA | 78 | 2294 |
| 1398320 | N/A | N/A | 165669 | 165688 | CTGTGGTTTTTCCTCAACCT | 38 | 2295 |
| 1398369 | N/A | N/A | 66353 | 66372 | CTGCAATTCCCCAAGGTGCT | 61 | 2296 |
| 1398381 | N/A | N/A | 51673 | 51692 | GTCCATACCCTTTAATATCT | 60 | 2297 |
| 1398401 | N/A | N/A | 158953 | 158972 | TATTTCAATATACAGTGTAT | 39 | 2298 |
| 1398414 | N/A | N/A | 49922 | 49941 | CTGGCCTGACTCTCTCACTC | 109 | 2299 |
| 1398426 | N/A | N/A | 98831 | 98850 | TGGCTACATCCTCAATTCAT | 51 | 2300 |
| 1398427 | N/A | N/A | 38283 | 38302 | GCATGTGTCCTACCTGCCTT | 70 | 2301 |
| 1398433 | N/A | N/A | 265827 | 265846 | GCCAGATCATTTCACGATCT | 71 | 2302 |
| 1398447 | N/A | N/A | 91411 | 91430 | GACCAATTACCTCTTCTTTT | 44 | 2303 |
| 1398461 | N/A | N/A | 190221 | 190240 | GCAGGGCATATTCCTGGTGC | 61 | 2304 |
| 1398464 | N/A | N/A | 30125 | 30144 | CCTGGATTTCAACCTCACCC | 49 | 2305 |
| 1398489 | N/A | N/A | 15940 | 15959 | CACTGCTGTCCACACAGGGC | 39 | 2306 |
| 1398550 | N/A | N/A | 177517 | 177536 | CTCTTGTTAAATCATGGCAT | 20 | 2307 |
| 1398581 | N/A | N/A | 32356 | 32375 | GCCAATCAATCACCAATGCT | 47 | 2308 |
| 1398588 | N/A | N/A | 289346 | 289365 | TTGGGCATCATTTTGCTCC | 87 | 2309 |
| 1398592 | N/A | N/A | 274792 | 274811 | CCCAGCTTTCCACAAAGACC | 72 | 2310 |
| 1398605 | N/A | N/A | 130155 | 130174 | GTGGGCTGATATTCTCACTT | 73 | 2311 |
| 1398645 | N/A | N/A | 23495 | 23514 | TCTGATCCCCTTCATACCCT | 75 | 2312 |
| 1398654 | N/A | N/A | 226647 | 226666 | AGGTCTGTAACCTCAAGTCT | 89 | 2313 |
| 1398676 | N/A | N/A | 186379 | 186398 | TTCCTAGTACATCACTGCTT | 83 | 2314 |

TABLE 30-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398685 | N/A | N/A | 20259 | 20278 | GCATGCTTAACTTCAAGGTT | 58 | 2315 |
| 1398725 | N/A | N/A | 104232 | 104251 | GTTGGTCTATATATTTCAGG | 39 | 2316 |
| 1398731 | N/A | N/A | 105673 | 105692 | ATGCCATCAGTCTCTTCTCA | 92 | 2317 |
| 1398753 | N/A | N/A | 12184 | 12203 | GCTACTACATATCACTTTTC | 70 | 2318 |
| 1398767 | N/A | N/A | 210196 | 210215 | TCACCACCTTTATTGTCTTT | 68 | 2319 |
| 1398773 | N/A | N/A | 122200 | 122219 | GCACAAATCTAGATTAGCAT | 83 | 2320 |
| 1398834 | N/A | N/A | 90263 | 90282 | TTCTCACCTATCATCTAGGA | 39 | 2321 |
| 1398848 | N/A | N/A | 74558 | 74577 | GCACATCATAATCCTGAGTT | 50 | 2322 |
| 1398855 | N/A | N/A | 172144 | 172163 | GATCCATCACATCTAGGCAT | 116 | 2323 |
| 1398884 | N/A | N/A | 58491 | 58510 | ACGGCATCCTCACCTGCATC | 91 | 2324 |
| 1398932 | 2486 | 2505 | 292470 | 292489 | CAGGCATCTACTTGTGTTAC | 52 | 2325 |
| 1398946 | N/A | N/A | 260386 | 260405 | GGTGCATACACATTCATCTT | 28 | 2326 |
| 1398947 | N/A | N/A | 283736 | 283755 | CCCCAATTTCCATCAGCAGC | 74 | 2327 |
| 1399025 | N/A | N/A | 135887 | 135906 | CTACCTTCATTTTTATAGCA | 57 | 2328 |
| 1399043 | N/A | N/A | 19244 | 19263 | TGAACAACTCAACATCTCCA | 78 | 2329 |
| 1399065 | N/A | N/A | 88565 | 88584 | ACACATGCATCTCCCATGAC | 136 | 2330 |
| 1399078 | N/A | N/A | 96475 | 96494 | TGCCTCATTTTCTATGCATC | 68 | 2331 |
| 1399114 | N/A | N/A | 271036 | 271055 | TGGATGGTTTTCTCCCACCA | 52 | 2332 |
| 1399188 | N/A | N/A | 31682 | 31701 | ACAGCCCTCACTCGATCTTT | 139 | 2333 |
| 1399210 | N/A | N/A | 94735 | 94754 | TCCACTTTCTTCTTTGATTC | 162 | 2334 |
| 1399213 | N/A | N/A | 104672 | 104691 | ATCATGTAATACTCAGACAC | 80 | 2335 |
| 1399299 | N/A | N/A | 6949 | 6968 | CCTGGGATATAAACCTGGCT | 76 | 2336 |
| 1399335 | N/A | N/A | 26944 | 26963 | GTTTGCCCCATTGACCTATC | 47 | 2337 |
| 1399355 | N/A | N/A | 151234 | 151253 | CCGCAACGCATTGCACGGTA | 230 | 2338 |
| 1399400 | N/A | N/A | 154701 | 154720 | GCTCTAGCTTAAATTGGACC | 120 | 2339 |
| 1399438 | N/A | N/A | 115880 | 115899 | CCTATCTTTCTGTACTGCCA | 88 | 2340 |
| 1399466 | N/A | N/A | 22456 | 22475 | ACAGCAGCAATTTATAGCAG | 62 | 2341 |

TABLE 31

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 33 | 178 |
| 1396898 | N/A | N/A | 66354 | 66373 | GCTGCAATTCCCCAAGGTGC | 70 | 2342 |

TABLE 31-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1396901 | N/A | N/A | 49925 | 49944 | GCACTGGCCTGACTCTCTCA | 73 | 2343 |
| 1397569 | N/A | N/A | 222521 | 222540 | TGCTTGTATTTATAAGCACA | 36 | 2344 |
| 1397581 | N/A | N/A | 186468 | 186487 | AGGCTATTACCTCCCTTCCT | 69 | 2345 |
| 1397594 | N/A | N/A | 207838 | 207857 | TAGCAAGATTTTATCGAACT | 65 | 2346 |
| 1397608 | N/A | N/A | 283742 | 283761 | GCTCCACCCCAATTTCCATC | 59 | 2347 |
| 1397658 | N/A | N/A | 90272 | 90291 | GGTTTCTTTTTCTCACCTAT | 36 | 2348 |
| 1397715 | N/A | N/A | 85022 | 85041 | TAGGACATTCATTTTTGACC | 40 | 2349 |
| 1397722 | N/A | N/A | 88566 | 88585 | CACACATGCATCTCCCATGA | 78 | 2350 |
| 1397727 | N/A | N/A | 285978 | 285997 | CGGGCATTTTTCACTCTAAA | 33 | 2351 |
| 1397742 | N/A | N/A | 103103 | 103122 | GGCTACTCTTCAACTTAGTC | 72 | 2352 |
| 1397748 | N/A | N/A | 228774 | 228793 | CTAAATCAGTTCTCTTGCTA | 66 | 2353 |
| 1397758 | N/A | N/A | 159826 | 159845 | CAGCATGCTACTACTGAGGC | 43 | 2354 |
| 1397785 | N/A | N/A | 7205 | 7224 | CTGCATTCAGCCCCTTACCT | 73 | 2355 |
| 1397848 | N/A | N/A | 74564 | 74583 | TGTGTAGCACATCATAATCC | 60 | 2356 |
| 1397917 | N/A | N/A | 104673 | 104692 | GATCATGTAATACTCAGACA | 85 | 2357 |
| 1397926 | N/A | N/A | 30126 | 30145 | GCCTGGATTTCAACCTCACC | 63 | 2358 |
| 1397945 | N/A | N/A | 130298 | 130317 | GCCAAGTATTTTCCTGCATC | 30 | 2359 |
| 1397952 | N/A | N/A | 28245 | 28264 | GCTACTGACATAATACACAT | 79 | 2360 |
| 1398107 | N/A | N/A | 20318 | 20337 | TCCCAGACACAGCACTGGCA | 58 | 2361 |
| 1398187 | N/A | N/A | 40668 | 40687 | TGCAATTTTTATTAACACAC | 66 | 2362 |
| 1398199 | N/A | N/A | 10435 | 10454 | GAACCATCTTAATCACTCCT | 31 | 2363 |
| 1398212 | N/A | N/A | 180718 | 180737 | GTCAGGCCTACACCTCTGCA | 52 | 2364 |
| 1398240 | N/A | N/A | 271136 | 271155 | CCTACCGTTTAATTTCTTTC | 97 | 2365 |
| 1398257 | N/A | N/A | 105717 | 105736 | GCTCCAACAATCTGCAACTC | 78 | 2366 |
| 1398301 | N/A | N/A | 43305 | 43324 | GCTAAGCTTACGCTAAGGGC | 50 | 2367 |
| 1398329 | N/A | N/A | 265988 | 266007 | TCTACATATTATATCTAGGT | 35 | 2368 |
| 1398333 | N/A | N/A | 47961 | 47980 | CTGTACAATCTATATCTCGC | 69 | 2369 |
| 1398384 | N/A | N/A | 158955 | 158974 | GATATTTCAATATACAGTGT | 47 | 2370 |
| 1398412 | N/A | N/A | 31684 | 31703 | ACACAGCCCTCACTCGATCT | 100 | 2371 |
| 1398430 | N/A | N/A | 9500 | 9519 | CTGTTCACAGTTCCTTGCAC | 35 | 2372 |
| 1398462 | N/A | N/A | 8042 | 8061 | CCTAGAGCAATCATTGTACT | 69 | 2373 |
| 1398469 | N/A | N/A | 86873 | 86892 | AGGCATGCTCTACATACTCT | 40 | 2374 |
| 1398473 | N/A | N/A | 96476 | 96495 | TTGCCTCATTTTCTATGCAT | 59 | 2375 |
| 1398474 | N/A | N/A | 115885 | 115904 | GTATTCCTATCTTTCTGTAC | 90 | 2376 |
| 1398507 | N/A | N/A | 210617 | 210636 | TGGCATCTTATCATAATAGA | 72 | 2377 |
| 1398522 | N/A | N/A | 101642 | 101661 | CGGATTATTTCACATTCTCT | 35 | 2378 |

TABLE 31-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1398537 | 2605 | 2624 | 292589 | 292608 | GCACTAGTTTGATACAGCTA | 52 | 2379 |
| 1398573 | N/A | N/A | 16032 | 16051 | GCTTTCAAAGAACAAGCACA | 60 | 2380 |
| 1398594 | N/A | N/A | 196386 | 196405 | TGGCATTCATTCTTTGTATA | 75 | 2381 |
| 1398599 | N/A | N/A | 22457 | 22476 | GACAGCAGCAATTTATAGCA | 64 | 2382 |
| 1398668 | N/A | N/A | 59221 | 59240 | GCTTCTTGACTTTACAGCTA | 66 | 2383 |
| 1398670 | 2071 | 2090 | 276401 | 276420 | GATGATGAACTTCATATCCT | 76 | 2384 |
| 1398688 | N/A | N/A | 46464 | 46483 | TCTGCAACTATGAACAGGGT | 41 | 2385 |
| 1398721 | N/A | N/A | 98846 | 98865 | TCCTTTTCCAATATTTGGCT | 58 | 2386 |
| 1398723 | N/A | N/A | 33955 | 33974 | CTTCATCCCTACTTTGGTCA | 70 | 2387 |
| 1398757 | N/A | N/A | 25020 | 25039 | CATCCACACTCAGAACTTCC | 71 | 2388 |
| 1398758 | N/A | N/A | 172146 | 172165 | AGGATCCATCACATCTAGGC | 114 | 2389 |
| 1398774 | N/A | N/A | 51680 | 51699 | CCACATTGTCCATACCCTTT | 68 | 2390 |
| 1398778 | N/A | N/A | 53335 | 53354 | AGCTTCTTTTCTCCTACATT | 51 | 2391 |
| 1398781 | N/A | N/A | 234726 | 234745 | AGCCAGCTTTTCCTTTCACA | 54 | 2392 |
| 1398806 | 743 | 762 | 152005 | 152024 | TCGGCTTCTTCTTCTTCCAC | 18† | 2393 |
| 1398846 | N/A | N/A | 36063 | 36082 | TTGTTCCATCAACAAAGGGC | 60 | 2394 |
| 1398917 | N/A | N/A | 32357 | 32376 | AGCCAATCAATCACCAATGC | 63 | 2395 |
| 1398933 | N/A | N/A | 247463 | 247482 | GCTGATTTGATAACCACAAT | 57 | 2396 |
| 1398944 | N/A | N/A | 27003 | 27022 | AGACACTTTTATCTTGCACT | 32 | 2397 |
| 1398992 | N/A | N/A | 122406 | 122425 | GCTCACTCCTACCTCCCTTA | 90 | 2398 |
| 1399002 | N/A | N/A | 104233 | 104252 | TGTTGGTCTATATATTTCAG | 41 | 2399 |
| 1399018 | N/A | N/A | 23570 | 23589 | TGGGTCTGCTATTTCTCGAT | 49 | 2400 |
| 1399036 | N/A | N/A | 19413 | 19432 | ATTGTCTTAAAGCTCCTGGC | 52 | 2401 |
| 1399073 | N/A | N/A | 190328 | 190347 | CGTTTTGATTTTTCCCTCC | 31 | 2402 |
| 1399097 | 668 | 687 | 122973 | 122992 | GCATAGTCTGTGTCTGCTCC | 14† | 2403 |
| 1399107 | N/A | N/A | 166225 | 166244 | GTGATTTTCCCAATTCTGGA | 33 | 2404 |
| 1399142 | N/A | N/A | 177518 | 177537 | TCTCTTGTTAAATCATGGCA | 33 | 2405 |
| 1399152 | N/A | N/A | 136218 | 136237 | CCTTGGCTCCAATTTTCCAA | 55 | 2406 |
| 1399174 | N/A | N/A | 94736 | 94755 | GTCCACTTTCTTCTTTGATT | 43 | 2407 |
| 1399198 | N/A | N/A | 15168 | 15187 | GTTCAAATTCTGCCTGCCTT | 73 | 2408 |
| 1399225 | N/A | N/A | 274802 | 274821 | TCCCTACCTTCCCAGCTTTC | 82 | 2409 |
| 1399271 | N/A | N/A | 83555 | 83574 | GCTCTACCTCTGACCAAGCT | 93 | 2410 |
| 1399277 | N/A | N/A | 38376 | 38395 | CTCAAACTCATTCCTAAGCA | 75 | 2411 |
| 1399284 | N/A | N/A | 13699 | 13718 | AGCTGCCTTTACATTCAAAC | 91 | 2412 |
| 1399308 | N/A | N/A | 154733 | 154752 | TCTATATTTTGGTCCCAACC | 71 | 2413 |
| 1399323 | N/A | N/A | 260566 | 260585 | CCTCATTAGATTTCCTCCAA | 86 | 2414 |

TABLE 31-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1399342 | N/A | N/A | 289347 | 289366 | CTTGGGCATCATTTTTGCTC | 90 | 2415 |
| 1399389 | N/A | N/A | 92206 | 92225 | ATCAGTTTTTCTCTAGGTAT | 45 | 2416 |
| 1399411 | N/A | N/A | 12284 | 12303 | ACTCTTCAGTTATATCCTCA | 33 | 2417 |
| 1399457 | N/A | N/A | 218044 | 218063 | CGGCTGCTTTTCACTTCCAC | 46 | 2418 |

TABLE 32

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1354057 | N/A | N/A | 158958 | 158977 | GCAGATATTTCAATATACAG | 17 | 178 |
| 1394556 | 669 | 688 | 122974 | 122993 | TGCATAGTCTGTGTCTGCTC | 33† | 2419 |
| 1397532 | 1511 | 1530 | 218264 | 218283 | CGGACATACTTCTTTAGCAT | 54 | 2420 |
| 1397537 | N/A | N/A | 74671 | 74690 | GCTTTTCCATACCAGTCCCT | 69 | 2421 |
| 1397540 | N/A | N/A | 19417 | 19436 | CCAGATTGTCTTAAAGCTCC | 48 | 2422 |
| 1397557 | N/A | N/A | 235275 | 235294 | GCCTTTTCCATCCAAGGACT | 41 | 2423 |
| 1397559 | N/A | N/A | 247481 | 247500 | GCCTTTTCATACCCATCTGC | 54 | 2424 |
| 1397610 | N/A | N/A | 10436 | 10455 | GGAACCATCTTAATCACTCC | 30 | 2425 |
| 1397612 | N/A | N/A | 25024 | 25043 | CCAACATCCACACTCAGAAC | 73 | 2426 |
| 1397634 | N/A | N/A | 283785 | 283804 | TCCTCACACTGCTCATCCAC | 102 | 2427 |
| 1397642 | N/A | N/A | 136220 | 136239 | GTCCTTGGCTCCAATTTTCC | 63 | 2428 |
| 1397669 | 3339 | 3358 | 293323 | 293342 | TGCCACTTCCATTTTCATCT | 71 | 2429 |
| 1397691 | N/A | N/A | 83558 | 83577 | CCTGCTCTACCTCTGACCAA | 70 | 2430 |
| 1397735 | N/A | N/A | 86957 | 86976 | CATCAGTTACACCTATGTCC | 49 | 2431 |
| 1397766 | N/A | N/A | 59222 | 59241 | TGCTTCTTGACTTTACAGCT | 76 | 2432 |
| 1397777 | N/A | N/A | 48017 | 48036 | GATGTCTTTTTGACATGTCT | 64 | 2433 |
| 1397778 | N/A | N/A | 105774 | 105793 | AGACTGTCACTCTCACGCCC | 75 | 2434 |
| 1397808 | N/A | N/A | 30158 | 30177 | TTTCACTTAGCTTAAGGCCA | 49 | 2435 |
| 1397881 | N/A | N/A | 51695 | 51714 | TCTGGTACATACATTCCACA | 55 | 2436 |
| 1397894 | N/A | N/A | 85109 | 85128 | ACCAGGTGAAATCTTCTTTC | 31 | 2437 |
| 1397897 | N/A | N/A | 16183 | 16202 | CTGTTTCAATAACACCAGCA | 31 | 2438 |
| 1397906 | N/A | N/A | 222522 | 222541 | TTGCTTGTATTTATAAGCAC | 45 | 2439 |
| 1397920 | N/A | N/A | 22543 | 22562 | GCCTTTCCTTATTTTTGCTA | 54 | 2440 |
| 1397938 | N/A | N/A | 260600 | 260619 | GCCCATGATGACCTTTCCCT | 72 | 2441 |
| 1397942 | N/A | N/A | 166367 | 166386 | GTGGTGACATTTCATGAGCC | 49 | 2442 |
| 1397944 | N/A | N/A | 43321 | 43340 | ATGACTCAACCATTTGGCTA | 71 | 2443 |

TABLE 32-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1397951 | N/A | N/A | 13702 | 13721 | GTAAGCTGCCTTTACATTCA | 75 | 2444 |
| 1397958 | N/A | N/A | 153124 | 153143 | CCTTTAGTTCTTTTAGTTCA | 31 | 2445 |
| 1397966 | N/A | N/A | 130873 | 130892 | GCCATCCCTCTTCTGCCCAT | 75 | 2446 |
| 1397988 | N/A | N/A | 92207 | 92226 | TATCAGTTTTTCTCTAGGTA | 56 | 2447 |
| 1397997 | N/A | N/A | 7211 | 7230 | CTGGTCCTGCATTCAGCCCC | 53 | 2448 |
| 1398044 | N/A | N/A | 159947 | 159966 | GTGCATCCTCTCCATCTTCA | 36 | 2449 |
| 1398049 | N/A | N/A | 46664 | 46683 | AGACTTTCAAATTCTAGCCA | 54 | 2450 |
| 1398057 | N/A | N/A | 9536 | 9555 | TTGCTAGCAAAGATTCTACT | 51 | 2451 |
| 1398069 | N/A | N/A | 196682 | 196701 | GTGCAACTCTGAACTAGGTA | 31 | 2452 |
| 1398091 | N/A | N/A | 28246 | 28265 | TGCTACTGACATAATACACA | 77 | 2453 |
| 1398134 | N/A | N/A | 190811 | 190830 | GCAACATATACTGCTATATT | 36 | 2454 |
| 1398141 | N/A | N/A | 266245 | 266264 | GTACAAACTCTCTACCAGGC | 41 | 2455 |
| 1398148 | N/A | N/A | 210708 | 210727 | AGCTTATTACTTGACAGTTC | 31 | 2456 |
| 1398173 | N/A | N/A | 271262 | 271281 | CCATCACAGAACATTCTTGT | 67 | 2457 |
| 1398196 | N/A | N/A | 49936 | 49955 | CCTACTCTTTAGCACTGGCC | 85 | 2458 |
| 1398281 | N/A | N/A | 36102 | 36121 | GCTGTTCCAATGATTTTCCT | 38 | 2459 |
| 1398303 | N/A | N/A | 27078 | 27097 | CCTTCCTTCTATGTACAGTC | 20 | 2460 |
| 1398347 | N/A | N/A | 31686 | 31705 | CCACACAGCCCTCACTCGAT | 96 | 2461 |
| 1398348 | N/A | N/A | 277174 | 277193 | CCATGATCTTACTCTTGCAA | 77 | 2462 |
| 1398349 | N/A | N/A | 98868 | 98887 | GGGCTATTCTTTCTTTTCCC | 34 | 2463 |
| 1398367 | N/A | N/A | 101645 | 101664 | TTCCGGATTATTTCACATTC | 39 | 2464 |
| 1398431 | N/A | N/A | 207865 | 207884 | TCTTGTTACATACTTCCCAT | 52 | 2465 |
| 1398510 | N/A | N/A | 38397 | 38416 | CAGCACATTTAGCCTTATTA | 39 | 2466 |
| 1398542 | N/A | N/A | 228776 | 228795 | TGCTAAATCAGTTCTCTTGC | 43 | 2467 |
| 1398552 | N/A | N/A | 289359 | 289378 | ACGCCATTTGAACTTGGGCA | 68 | 2468 |
| 1398610 | N/A | N/A | 96477 | 96496 | TTTGCCTCATTTTCTATGCA | 67 | 2469 |
| 1398633 | N/A | N/A | 186566 | 186585 | CAGCAATACCAACATCACAT | 41 | 2470 |
| 1398679 | N/A | N/A | 104235 | 104254 | AATGTTGGTCTATATATTTC | 70 | 2471 |
| 1398710 | N/A | N/A | 33956 | 33975 | ACTTCATCCCTACTTTGGTC | 46 | 2472 |
| 1398722 | N/A | N/A | 32393 | 32412 | GCCTCTGAAAACATCTGGCA | 71 | 2473 |
| 1398904 | N/A | N/A | 8043 | 8062 | TCCTAGAGCAATCATTGTAC | 68 | 2474 |
| 1398927 | N/A | N/A | 115886 | 115905 | CGTATTCCTATCTTTCTGTA | 73 | 2475 |
| 1398939 | N/A | N/A | 53336 | 53355 | GAGCTTCTTTTCTCCTACAT | 57 | 2476 |

TABLE 32-continued

Reduction of APP RNA by 5-10-5 MOE gapmers with mixed PO/PS internucleoside linkages in SH-SY5Y cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1399040 | N/A | N/A | 95334 | 95353 | CCATAGAGCTCTCAATCCCA | 43 | 2477 |
| 1399071 | N/A | N/A | 103104 | 103123 | AGGCTACTCTTCAACTTAGT | 80 | 2478 |
| 1399074 | N/A | N/A | 285979 | 285998 | GCGGGCATTTTTCACTCTAA | 55 | 2479 |
| 1399136 | N/A | N/A | 158956 | 158975 | AGATATTTCAATATACAGTG | 35 | 2480 |
| 1399184 | N/A | N/A | 274805 | 274824 | CTATCCCTACCTTCCCAGCT | 74 | 2481 |
| 1399204 | N/A | N/A | 154735 | 154754 | TCTCTATATTTTGGTCCCAA | 42 | 2482 |
| 1399243 | N/A | N/A | 23665 | 23684 | TGGTGCCACCTCTAGTGGTC | 63 | 2483 |
| 1399302 | N/A | N/A | 20324 | 20343 | GCATTGTCCCAGACACAGCA | 22 | 2484 |
| 1399324 | N/A | N/A | 88569 | 88588 | TCCCACACATGCATCTCCCA | 56 | 2485 |
| 1399333 | N/A | N/A | 104715 | 104734 | TCAAACTCTCCATACTCCCA | 74 | 2486 |
| 1399367 | N/A | N/A | 12285 | 12304 | TACTCTTCAGTTATATCCTC | 34 | 2487 |
| 1399379 | N/A | N/A | 90273 | 90292 | GGGTTTCTTTTTCTCACCTA | 42 | 2488 |
| 1399410 | N/A | N/A | 172755 | 172774 | ACTCATCCCTGATTGCCTCA | 57 | 2489 |
| 1399421 | N/A | N/A | 66369 | 66388 | TTGTTTGCCTTCAATGCTGC | 72 | 2490 |
| 1399441 | N/A | N/A | 41109 | 41128 | GTGCATCATATTCTACACTA | 41 | 2491 |
| 1399453 | N/A | N/A | 122502 | 122521 | GTAGCAGTCTCCACTGGTGA | 67 | 2492 |
| 1399474 | N/A | N/A | 177757 | 177776 | GGAGGCTCTTTCTCTACTTC | 48 | 2493 |
| 1399487 | N/A | N/A | 15196 | 15215 | GTTCACCTTCACACATCCTT | 50 | 2494 |
| 1399498 | N/A | N/A | 180976 | 180995 | CTCCTGTCTTTACAACGACC | 46 | 2495 |

Example 2: Effect of Mixed Backbone Gapmers on Human APP RNA In Vitro, Single Dose Modified oligonucleotides complementary to human APP nucleic acid were synthesized and tested for their effect on APP RNA levels in vitro. The modified oligonucleotides were tested in experiment A or experiment B using the same culture conditions, as indicated in the tables below. "Start site" in all the tables below indicates the 5'-most nucleoside of the target sequence to which the modified oligonucleotide is complementary. "Stop site" in all the tables below indicates the 3'-most nucleoside of the target sequence to which the modified oligonucleotide is complementary. As shown in the tables below, the modified oligonucleotides are complementary to SEQ ID NO: 1 (described herein above), SEQ ID NO: 2 (described herein above), or SEQ ID NO: 8 (GEN-BANK Accession No. NM_201414.2). 'N/A' indicates that the modified oligonucleotide is not complementary to that particular target sequence with 100% complementarity.

Cultured SH-SY5Y cells at a density of 20,000 cells per well were transfected treated with 4,000 nM of modified oligonucleotide using by electroporation with 4000 nM of modified oligonucleotide. After a treatment period of approximately 24 hours, RNA was isolated from the cells and APP RNA levels were measured by quantitative real-time RTPCR. Human APP primer probe set RTS35572 (described herein above) was used to measure APP RNA levels. APP RNA levels were normalized to total RNA content, as measured by RIBOGREEN®. Results are presented as percent of APP RNA, relative to untreated control cells (% UTC). The values marked by the symbol "f" indicate that the modified oligonucleotide is complementary to the amplicon region of the primer probe set. Additional assays may be used to measure the activity of the modified oligonucleotides complementary to the amplicon region.

The modified oligonucleotides in the tables below are 5-10-5 MOE gapmers. The gapmers are 20 nucleosides in length. The sugar motif of the gapmers is (from 5' to 3'): eeeeedddddddddddeeeee; wherein each 'd' represents a 2'-β-D-deoxyribosyl sugar moiety, and each 'e' represents a 2'-MOE sugar moiety. The internucleoside motif of the gapmers is (from 5' to 3'): sooossssssssssssooss, wherein each "s" represents a phosphorothioate internucleoside linkage and each "o" represents a phosphodiester internucleoside linkage. Each cytosine nucleoside is a 5-methyl cytosine.

TABLE 33

Reduction of APP RNA by 5-10-5 MOE gapmers with mixed PO/PS internucleoside linkages complementary to human APP

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | Expt. ID | SEQ ID NO |
|---|---|---|---|---|---|---|---|---|
| 1332176 | 2409 | 2428 | 292393 | 292412 | ACATTATTCTATAAATGGAC | 59 | A | 2496 |
| 1332177 | 2030 | 2049 | 276360 | 276379 | TCCATCTTCACTTCAGAGAT | 69 | A | 2497 |
| 1332178 | 2095 | 2114 | N/A | N/A | CTTCTGCAAAGAACACCAAT | 74 | A | 2498 |
| 1332179 | 2090 | 2109 | N/A | N/A | GCAAAGAACACCAATTTTTG | 66 | A | 2499 |
| 1332180 | 2133 | 2152 | 282167 | 282186 | CATGAGTCCAATGATTGCAC | 63 | A | 2500 |
| 1332181 | 2151 | 2170 | 282185 | 282204 | TATGACAACACCGCCCACCA | 78 | B | 2501 |
| 1332182 | 2144 | 2163 | 282178 | 282197 | ACACCGCCCACCATGAGTCC | 65 | B | 2502 |
| 1332183 | 2441 | 2460 | 292425 | 292444 | GAGTAAATCATAAAACGGGT | 22 | B | 2503 |
| 1332184 | 3364 | 3383 | 293348 | 293367 | GCATGCCTTCCTCATCCCCT | 80 | A | 2504 |
| 1332185 | 2416 | 2435 | 292400 | 292419 | TCTTCCCACATTATTCTATA | 47 | A | 2505 |
| 1332186 | 2029 | 2048 | 276359 | 276378 | CCATCTTCACTTCAGAGATC | 65 | A | 2506 |
| 1332187 | 1895 | 1914 | 262212 | 262231 | TCAGCCCCAAAAGAATGCCA | 70 | A | 2507 |
| 1332188 | 1341 | 1360 | 198780 | 198799 | CAAAGATTCCACTTTCTCCT | 51 | A | 2508 |
| 1332189 | 1342 | 1361 | 198781 | 198800 | CCAAAGATTCCACTTTCTCC | 51 | A | 2509 |
| 1332190 | 1407 | 1426 | 198846 | 198865 | CATGGCTTCCACTCTGGCCA | 67 | B | 2510 |
| 1332192 | 1343 | 1362 | 198782 | 198801 | TCCAAAGATTCCACTTTCTC | 40 | B | 2511 |
| 1332193 | 1638 | 1657 | 219328 | 219347 | CATGCGCTCATAAATCACAC | 59† | A | 2512 |
| 1332194 | 3318 | 3337 | 293302 | 293321 | CTTTTGTATCATAAATGAAA | 6 | A | 2513 |
| 1332195 | 1894 | 1913 | 262211 | 262230 | CAGCCCCAAAAGAATGCCAC | 23 | A | 2514 |
| 1332196 | 1302 | 1321 | 198016 | 198035 | CTTCTTATCAGCTTTAGGCA | 53 | A | 2515 |
| 1332197 | 573 | 592 | 122878 | 122897 | ACACACAAACTCTACCCCTC | 44 | A | 2516 |
| 1332198 | 567 | 586 | 122872 | 122891 | AAACTCTACCCCTCGGAACT | 52 | A | 2517 |
| 1332199 | 683 | 702 | N/A | N/A | TCTTCACTCCCATCTGCATA | 3† | B | 2518 |
| 1332200 | 562 | 581 | 122867 | 122886 | CTACCCCTCGGAACTTGTCA | 12 | B | 2519 |
| 1332201 | 726 | 745 | 151988 | 152007 | CACCTCAGCCACTTCTTCCT | 6† | A | 2520 |
| 1332202 | 611 | 630 | 122916 | 122935 | GCAGAATCCACATTGTCACT | 5 | A | 2521 |
| 1332203 | 706 | 725 | 151968 | 151987 | CCTCTGCTACTTCTACTACT | 2† | A | 2522 |
| 1332204 | 1258 | 1277 | 197972 | 197991 | CTTCCCATTCTCTCATGACC | 12 | A | 2523 |
| 1332205 | 734 | 753 | 151996 | 152015 | TCTTCTTCCACCTCAGCCAC | 3† | A | 2524 |
| 1332206 | N/A | N/A | 3189 | 3208 | GCTCAGAGCCAGGCGAGTCA | 13 | A | 2525 |
| 1332207 | 392 | 411 | 120655 | 120674 | GCATCACTTACAAACTCACC | 16 | B | 2526 |
| 1332208 | 2950 | 2969 | 292934 | 292953 | TGTGCACATAAAACAGGCAC | 47 | B | 2527 |
| 1332209 | 181 | 200 | 61944 | 61963 | GATCTGAATCCCACTTCCCA | 11 | A | 2528 |
| 1332210 | 172 | 191 | 61935 | 61954 | CCCACTTCCCATTCTGGACA | 12 | A | 2529 |
| 1332211 | 162 | 181 | 61925 | 61944 | ATTCTGGACATTCATGTGCA | 12 | A | 2530 |

TABLE 33-continued

Reduction of APP RNA by 5-10-5 MOE gapmers with mixed PO/PS internucleoside linkages complementary to human APP

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | Expt. ID | SEQ ID NO |
|---|---|---|---|---|---|---|---|---|
| 1332212 | 391 | 410 | 120654 | 120673 | CATCACTTACAAACTCACCA | 8 | A | 2531 |
| 1332213 | 452 | 471 | 120715 | 120734 | GTTTCGCAAACATCCATCCT | 7 | A | 2532 |

TABLE 34

Reduction of APP RNA by 5-10-5 MOE gapmers with mixed PO/PS internucleoside linkages complementary to human APP

| Compound Number | SEQ ID No: 8 Start Site | SEQ ID No: 8 Stop Site | Sequence (5' to 3') | APP (% UTC) | Expt. ID | SEQ ID NO |
|---|---|---|---|---|---|---|
| 1332165 | 1053 | 1072 | GTAGGAACTCGAACCACCTC | 125 | A | 2533 |
| 1332166 | 1048 | 1067 | AACTCGAACCACCTCTTCCA | 104 | A | 2534 |
| 1332167 | 1047 | 1066 | ACTCGAACCACCTCTTCCAC | 71 | A | 2535 |
| 1332168 | 1049 | 1068 | GAACTCGAACCACCTCTTCC | 99 | A | 2536 |
| 1332169 | 1052 | 1071 | TAGGAACTCGAACCACCTCT | 14 | A | 2537 |
| 1332170 | 1051 | 1070 | AGGAACTCGAACCACCTCTT | 103 | A | 2538 |
| 1332171 | 1050 | 1069 | GGAACTCGAACCACCTCTTC | 103 | A | 2539 |
| 1332172 | 1055 | 1074 | TTGTAGGAACTCGAACCACC | 85 | A | 2540 |
| 1332173 | 1056 | 1075 | GTTGTAGGAACTCGAACCAC | 59 | A | 2541 |
| 1332174 | 1059 | 1078 | GCTGTTGTAGGAACTCGAAC | 85 | A | 2542 |

The modified oligonucleotides in the table below are 3-10-3 cEt gapmers. The gapmers are 16 nucleosides in length. The sugar motif of the gapmers is (from 5' to 3'): kkkddddddddddkkk; wherein each 'd' represents a 2'-β-D-deoxyribosyl sugar moiety, and each 'k' represents a cEt sugar moiety. The internucleoside motif of the gapmers is (from 5' to 3'): soossssssssssos, wherein each "s" represents a phosphorothioate internucleoside linkage and each "o" represents a phosphodiester internucleoside linkage. Each cytosine nucleoside is a 5-methyl cytosine.

TABLE 35

Reduction of APP RNA by 3-10-3 cEt gapmers with mixed PO/PS internucleoside linkages complementary to human APP

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | Expt. ID | SEQ ID NO |
|---|---|---|---|---|---|---|---|---|
| 1333912 | 3351 | 3366 | 293335 | 293350 | CCTTATATTGCCACTT | 45 | B | 2543 |
| 1333913 | 3349 | 3364 | 293333 | 293348 | TTATATTGCCACTTCC | 20 | A | 2544 |
| 1333914 | 2378 | 2393 | 292362 | 292377 | AGCAATGGTTTTGCTG | 55 | A | 2545 |
| 1333915 | 2022 | 2037 | 276352 | 276367 | TCAGAGATCTCCTCCG | 39 | A | 2546 |
| 1333916 | 1784 | 1799 | 262101 | 262116 | CGTAACTGATCCTTGG | 25 | A | 2547 |
| 1333917 | 1154 | 1169 | 191553 | 191568 | GATACTTGTCAACGGC | 14 | A | 2548 |

TABLE 35-continued

Reduction of APP RNA by 3-10-3 cEt gapmers with mixed PO/PS internucleoside linkages complementary to human APP

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | Expt. ID | SEQ ID NO |
|---|---|---|---|---|---|---|---|---|
| 1333918 | 2066 | 2081 | 276396 | 276411 | CTTCATATCCTGAGTC | 38 | A | 2549 |
| 1333919 | 2002 | 2017 | 276332 | 276347 | GATATTTGTCAACCCA | 24 | B | 2550 |
| 1333920 | 3348 | 3363 | 293332 | 293347 | TATATTGCCACTTCCA | 43 | B | 2551 |
| 1333921 | 3355 | 3370 | 293339 | 293354 | ATCCCCTTATATTGCC | 45 | A | 2552 |
| 1333922 | 527 | 542 | 122832 | 122847 | TGCCGTAGTCATGCAA | 44 | A | 2553 |
| 1333923 | 453 | 468 | 120716 | 120731 | TCGCAAACATCCATCC | 21 | A | 2554 |
| 1333924 | 3131 | 3146 | 293115 | 293130 | GTACAATCATCCTGCA | 39 | A | 2555 |
| 1333925 | 2617 | 2632 | 292601 | 292616 | CTATTCATGCACTAGT | 33 | A | 2556 |
| 1333926 | 1153 | 1168 | 191552 | 191567 | ATACTTGTCAACGGCA | 13 | A | 2557 |
| 1333927 | 525 | 540 | 122830 | 122845 | CCGTAGTCATGCAAGT | 12 | B | 2558 |
| 1333928 | 752 | 767 | 152014 | 152029 | CATCATCGGCTTCTTC | 9† | B | 2559 |
| 1333929 | 3130 | 3145 | 293114 | 293129 | TACAATCATCCTGCAG | 15 | A | 2560 |
| 1333930 | 451 | 466 | 120714 | 120729 | GCAAACATCCATCCTC | 17 | A | 2561 |
| 1333931 | 3150 | 3165 | 293134 | 293149 | TGTCATAAGCAATGAT | 33 | A | 2562 |
| 1333932 | 2501 | 2516 | 292485 | 292500 | TAATTCAAGTTCAGGC | 24 | A | 2563 |
| 1333933 | 2476 | 2491 | 292460 | 292475 | TGTTACAGCACAGCTG | 17 | A | 2564 |
| 1333934 | 2500 | 2515 | 292484 | 292499 | AATTCAAGTTCAGGCA | 72 | A | 2565 |
| 1333935 | 2483 | 2498 | 292467 | 292482 | CTACTTGTGTTACAGC | 18 | B | 2566 |

The modified oligonucleotides in the table below are 3-10-3 gapmers. The gapmers are 16 nucleosides in length. The sugar motif of the gapmers is (from 5' to 3'): kkkdydd-dddddddkkk; wherein each 'd' represents a 2'-β-D-deoxyribosyl sugar moiety, each 'y' represents a 2'-O-Me sugar moiety, and each 'k' represents a cEt sugar moiety. The internucleoside motif of the gapmers is (from 5' to 3'): soossssssssssos, wherein each "s" represents a phosphorothioate internucleoside linkage, and each 'o' represents a phosphodiester internucleoside linkage. Each 2'-OMe cytosine nucleoside is not methylated and is indicated by a bold underlined C Each other cytosine nucleoside is a 5-methylcytosine.

TABLE 36

Reduction of APP RNA by 3-10-3 cEt gapmers having a 2'-OMe at position 2 of the gap and mixed PO/PS internucleoside linkages complementary to human APP

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | Expt. ID | SEQ ID NO |
|---|---|---|---|---|---|---|---|---|
| 1335695 | 527 | 542 | 122832 | 122847 | TGCCGTAGTCATGCAA | 73 | B | 2553 |
| 1335696 | 2476 | 2491 | 292460 | 292475 | TGTTACAGCACAGCTG | 48 | A | 2564 |
| 1335697 | 2617 | 2632 | 292601 | 292616 | CTATUCATGCACTAGT | 23 | A | 2567 |
| 1335698 | 2483 | 2498 | 292467 | 292482 | CTACUTGTGTTACAGC | 22 | A | 2568 |
| 1335699 | 3130 | 3145 | 293114 | 293129 | TACAATCATCCTGCAG | 37 | A | 2560 |
| 1335700 | 3131 | 3146 | 293115 | 293130 | GTACAATCATCCTGCA | 22 | A | 2555 |
| 1335701 | 752 | 767 | 152014 | 152029 | CATCATCGGCTTCTTC | 9† | A | 2559 |

TABLE 36-continued

Reduction of APP RNA by 3-10-3 cEt gapmers having a 2'-OMe at position 2 of the gap and mixed PO/PS internucleoside linkages complementary to human APP

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | Expt. ID | SEQ ID NO |
|---|---|---|---|---|---|---|---|---|
| 1335702 | 451 | 466 | 120714 | 120729 | GCAAACATCCATCCTC | 10 | B | 2561 |
| 1335703 | 2501 | 2516 | 292485 | 292500 | TAATUCAAGTTCAGGC | 49 | B | 2569 |
| 1335704 | 525 | 540 | 122830 | 122845 | CCGTAGTCATGCAAGT | 26 | A | 2558 |
| 1335705 | 453 | 468 | 120716 | 120731 | TCGCAAACATCCATCC | 20 | A | 2554 |
| 1335706 | 3150 | 3165 | 293134 | 293149 | TGTCATAAGCAATGAT | 53 | A | 2562 |
| 1335707 | 2500 | 2515 | 292484 | 292499 | AATTCAAGTTCAGGCA | 17 | A | 2565 |
| 1335708 | 1153 | 1168 | 191552 | 191567 | ATACUTGTCAACGGCA | 9 | A | 2570 |
| 1335709 | 3355 | 3370 | 293339 | 293354 | ATCCCCTTATATTGCC | 10 | A | 2552 |
| 1335710 | 2022 | 2037 | 276352 | 276367 | TCAGAGATCTCCTCCG | 35 | B | 2546 |
| 1335711 | 3348 | 3363 | 293332 | 293347 | TATAUTGCCACTTCCA | 81 | B | 2571 |
| 1335712 | 1154 | 1169 | 191553 | 191568 | GATACTTGTCAACGGC | 16 | A | 2548 |
| 1335713 | 2002 | 2017 | 276332 | 276347 | GATAUTTGTCAACCCA | 27 | A | 2572 |
| 1335714 | 2066 | 2081 | 276396 | 276411 | CTTCATATCCTGAGTC | 51 | A | 2549 |
| 1335715 | 2378 | 2393 | 292362 | 292377 | AGCAATGGTTTTGCTG | 66 | A | 2545 |
| 1335716 | 3349 | 3364 | 293333 | 293348 | TTATATTGCCACTTCC | 39 | A | 2544 |
| 1335717 | 1784 | 1799 | 262101 | 262116 | CGTAACTGATCCTTGG | 11 | A | 2547 |
| 1335718 | 3351 | 3366 | 293335 | 293350 | CCTTATATTGCCACTT | 41 | B | 2543 |

Example 3: Effect of Mixed Backbone 5-10-5 MOE Gapmers on Human APP RNA In Vitro, Single Dose Modified oligonucleotides complementary to an APP nucleic acid were synthesized and tested for their effect on APP RNA levels in vitro. The modified oligonucleotides were tested in a series of experiments using the same culture conditions. The results for each separate experiment are presented in separate tables below.

The modified oligonucleotides are all 5-10-5 MOE gapmers. The sugar motif of the gapmers is (from 5' to 3'): eeeeedddddddddeeeee; wherein each 'd' represents a 2'-β-D-deoxyribosyl sugar moiety, and each 'e' represents a 2'-MOE sugar moiety. The internucleoside linkage motif for the gapmers is (from 5' to 3'): sooosssssssssssooss; wherein each 'o' represents a phosphodiester internucleoside linkage and each 's' represents a phosphorothioate internucleoside linkage. All cytosine nucleobases throughout each modified oligonucleotide are 5-methylcytosines.

"Start site" indicates the 5'-most nucleoside of the target sequence to which the modified oligonucleotide is complementary. "Stop site" indicates the 3'-most nucleoside of the target sequence to which the modified oligonucleotide is complementary. As shown in the tables below, the modified oligonucleotides are complementary to either SEQ ID NO: 1 (described herein above) or to SEQ ID NO: 2 (described herein above) or to both. 'N/A' indicates that the modified oligonucleotide is not complementary to that particular target sequence with 100% complementarity.

Cultured A431 cells at a density of 10,000 cells per well were treated by free uptake with 4000 nM of modified oligonucleotide. After a treatment period of approximately 48 hours, RNA was isolated from the cells and APP RNA levels were measured by quantitative real-time RTPCR. Human primer probe set RTS35432 (forward sequence GACAGACAGCACACCCTAAA, designated herein as SEQ ID NO: 14; reverse sequence CACACGGAGGTGTGTCATAA, designated herein as SEQ ID NO: 15; probe sequence ATCCCAAGAAAGCCGCTCAGATCC, designated herein as SEQ ID NO: 16) was used to measure RNA levels. APP RNA levels were normalized to total RNA content, as measured by RIBOGREEN®. Results are presented as percent APP RNA, relative to untreated control cells (% UTC). The values marked by the symbol "f" indicate that the modified oligonucleotide is complementary to the amplicon region of the primer probe set. Additional assays may be used to measure the activity of the modified oligonucleotides complementary to the amplicon region.

TABLE 37

Reduction of APP RNA by 5-10-5 MOE gapmers with mixed PO/PS internucleoside linkages in A431 cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1397572 | N/A | N/A | 224068 | 224087 | TGGCAAACTCTCTTAGGTTC | 8 | 1733 |
| 1399147 | N/A | N/A | 221342 | 221361 | TCATCAACTTTTTAGTCCTT | 9 | 1557 |
| 1463174 | N/A | N/A | 220783 | 220802 | CTGGGACACTGCACCTCCCT | 86 | 2573 |
| 1463179 | N/A | N/A | 222439 | 222458 | TCTGAATTTTAGTATGCTAT | 12 | 2574 |
| 1463181 | N/A | N/A | 221006 | 221025 | TCTCTGTTCTCAATTCATGG | 14 | 2575 |
| 1463194 | N/A | N/A | 220050 | 220069 | TGTACTATTTTCCAAGTTC | 10 | 2576 |
| 1463200 | N/A | N/A | 220135 | 220154 | TCAGTTTCCTGGTTTTGATA | 13 | 2577 |
| 1463212 | N/A | N/A | 219242 | 219261 | GGTTCTTTTTCTTTCTTTTT | 44 | 2578 |
| 1463220 | N/A | N/A | 222110 | 222129 | GTATTGTTTTAAATGTTCCT | 4 | 2579 |
| 1463226 | N/A | N/A | 220397 | 220416 | GATACATATTGCTTATATGT | 39 | 2580 |
| 1463237 | N/A | N/A | 226908 | 226927 | GTATCTGTTTGCCAATGGTA | 9 | 2581 |
| 1463249 | N/A | N/A | 229341 | 229360 | CATATTTCAAAATTAATCTC | 71 | 2582 |
|  | N/A | N/A | 229374 | 229393 |  |  |  |
| 1463252 | N/A | N/A | 221138 | 221157 | TGGAGAACTTCTTTACACTT | 11 | 2583 |
| 1463254 | N/A | N/A | 220458 | 220477 | CTGTATCTATTTCCAACCCA | 43 | 2584 |
| 1463260 | N/A | N/A | 219944 | 219963 | ATGGCTTCCCTGCTCAGCCA | 70 | 2585 |
| 1463269 | N/A | N/A | 218616 | 218635 | GTCATTGGTTTTAATCAGTT | 21 | 2586 |
| 1463272 | N/A | N/A | 222523 | 222542 | ATTGCTTGTATTTATAAGCA | 117 | 2587 |
| 1463274 | N/A | N/A | 219076 | 219095 | TCTTGTTCTCCTATTTCTGT | 78 | 2588 |
| 1463283 | N/A | N/A | 222735 | 222754 | CTCAGCATGACTCCATTCTT | 48 | 2589 |
| 1463286 | N/A | N/A | 220244 | 220263 | TCATGTGGTATTTATTCTC | 18 | 2590 |
| 1463288 | N/A | N/A | 229285 | 229304 | TCACTGATTTTTTCCCCTC | 9 | 2591 |
| 1463289 | N/A | N/A | 221316 | 221335 | GGCTTATTTCCCTATAGTTA | 10 | 2592 |
| 1463297 | N/A | N/A | 220057 | 220076 | ACCTCTCTGTACTATTTTC | 33 | 2593 |
| 1463299 | N/A | N/A | 219602 | 219621 | GCGACATTCCTCCAGTCTTA | 20 | 2594 |
| 1463302 | N/A | N/A | 225700 | 225719 | CCTAGTCTACTTTGGACCCA | 54 | 2595 |
| 1463310 | N/A | N/A | 225364 | 225383 | CTTTATTTCCTACTGCCTTT | 31 | 2596 |
| 1463317 | N/A | N/A | 222585 | 222604 | CCATTATTTAATTAAACCAT | 78 | 2597 |
| 1463321 | N/A | N/A | 221637 | 221656 | CCCCTAATATGTTCTTAATC | 76 | 2598 |
| 1463323 | N/A | N/A | 220971 | 220990 | CCACCTCCACTATCTTCATA | 53 | 2599 |
| 1463335 | N/A | N/A | 225455 | 225474 | CCGCATCTGGTTTATAATAA | 59 | 2600 |
| 1463338 | N/A | N/A | 221521 | 221540 | TTGTGCTGCCCTATTCTTGG | 16 | 2601 |
| 1463340 | N/A | N/A | 224096 | 224115 | ATCACTTTACTATCTGGGCT | 8 | 2602 |
| 1463346 | N/A | N/A | 220480 | 220499 | TGCTCTGATTCCAGATGATA | 29 | 2603 |
| 1463358 | N/A | N/A | 221089 | 221108 | TACTGATGTCTATTCTCCAA | 26 | 2604 |
| 1463359 | N/A | N/A | 222727 | 222746 | GACTCCATTCTTCCTCATTT | 17 | 2605 |
| 1463364 | N/A | N/A | 221216 | 221235 | ACCATGTTTTCTAGAAGATT | 16 | 2606 |

TABLE 37-continued

Reduction of APP RNA by 5-10-5 MOE gapmers with mixed PO/PS internucleoside linkages in A431 cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1463371 | N/A | N/A | 228219 | 228238 | CTGCAGCCTCAGCCACCCCA | 72 | 2607 |
| 1463406 | N/A | N/A | 222776 | 222795 | TTTAATGTCAATTTTCCCCT | 67 | 2608 |
| 1463407 | N/A | N/A | 233894 | 233913 | GCCAACATTACCTACTGCAA | 35 | 2609 |
| 1463409 | N/A | N/A | 222678 | 222697 | GCATAATTTACTGAAGCAGA | 10 | 2610 |
| 1463426 | N/A | N/A | 234807 | 234826 | TTCCACTTTCATGTTCCCTT | 12 | 2611 |
| 1463436 | N/A | N/A | 228946 | 228965 | ATGCCTCAGGCTCCATCCAT | 73 | 2612 |
| 1463452 | N/A | N/A | 234059 | 234078 | CCTTCCTTTTAATCAGAAT | 54 | 2613 |
| 1463466 | N/A | N/A | 221999 | 222018 | GCTCAGATAGTGTACAGGGT | 7 | 2614 |
| 1463468 | N/A | N/A | 234235 | 234254 | GCTCTCCTGTTACTGTTAAT | 23 | 2615 |
| 1463469 | N/A | N/A | 224596 | 224615 | GCTTTGTTATCTTGGCCAAC | 26 | 2616 |
| 1463473 | N/A | N/A | 220944 | 220963 | GCTCAACACTGAGTTGCTCC | 57 | 2617 |
| 1463477 | N/A | N/A | 232117 | 232136 | ACTCTTATGTCTGATCCCTT | 21 | 2618 |
| 1463483 | N/A | N/A | 220746 | 220765 | CTGCAAGTTATGTAGCTCAA | 12 | 2619 |
| 1463488 | N/A | N/A | 229154 | 229173 | ACACATCTGCTCTAGTGTTC | 58 | 2620 |
| 1463489 | N/A | N/A | 231289 | 231308 | CCTGTGTCCTTATTTCTTCA | 12 | 2621 |
| 1463490 | N/A | N/A | 234371 | 234390 | AGTTCATTCCCCTAGCCTGC | 50 | 2622 |
| 1463500 | N/A | N/A | 233352 | 233371 | ATCCAATGCATCAATTCCTT | 20 | 2623 |
| 1463524 | N/A | N/A | 234353 | 234372 | GCACTGATTCCTCTTTTTCT | 34 | 2624 |
| 1463526 | N/A | N/A | 222753 | 222772 | CCGATAGCATTCCTTCTTCT | 22 | 2625 |
| 1463528 | N/A | N/A | 222744 | 222763 | TTCCTTCTTCTCAGCATGAC | 27 | 2626 |
| 1463532 | N/A | N/A | 224124 | 224143 | GGCAGGTCTTGGCTTCCACC | 43 | 2627 |
| 1463534 | N/A | N/A | 233434 | 233453 | TCACCTTTTAATCTACAACT | 20 | 2628 |
| 1463535 | N/A | N/A | 231282 | 231301 | CCTTATTTCTTCAATCTCCT | 29 | 2629 |
| 1463536 | N/A | N/A | 222721 | 222740 | ATTCTTCCTCATTTTCACCC | 13 | 2630 |
| 1463540 | N/A | N/A | 221735 | 221754 | TGTTCTTTATTTTATTATA | 70 | 2631 |
| 1463546 | N/A | N/A | 226513 | 226532 | CTGTCTTAATAGTATACCGT | 14 | 2632 |
| 1463549 | N/A | N/A | 231033 | 231052 | ACTCCACAGTCCCTCATCCT | 86 | 2633 |
| 1463559 | N/A | N/A | 220679 | 220698 | ATCATCACTTGACACATGCC | 24 | 2634 |
| 1463564 | N/A | N/A | 230913 | 230932 | TTGCATGTCATCCTTGTGCA | 46 | 2635 |
| 1463567 | N/A | N/A | 223618 | 223637 | AGCAGCTTTTTTTTTTCTT | 11 | 2636 |
| 1463568 | N/A | N/A | 218641 | 218660 | TACAACTTTGTTTTTCTCA | 57 | 2637 |
| 1463578 | N/A | N/A | 220897 | 220916 | AAGTTGCTTTTTTTCTCTTC | 9 | 2638 |
| 1463580 | N/A | N/A | 231654 | 231673 | AGTCTTTAGTCTTATTCATC | 11 | 2639 |
| 1463587 | N/A | N/A | 223728 | 223747 | AATGCCAGCTCTTTTCTCCG | 18 | 2640 |
| 1463589 | N/A | N/A | 222548 | 222567 | GTTTGACTGCATTAAGCACA | 9 | 2641 |
| 1463595 | N/A | N/A | 222458 | 222477 | TTCTCCTTTTGCCAGTGTCT | 6 | 2642 |

TABLE 37-continued

Reduction of APP RNA by 5-10-5 MOE gapmers with mixed PO/PS internucleoside linkages in A431 cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1463596 | N/A | N/A | 222761 | 222780 | CCCCTTCACCGATAGCATTC | 55 | 2643 |
| 1463597 | N/A | N/A | 229342 | 229361 | ACATATTTCAAAATTAATCT | 83 | 2644 |
|  | N/A | N/A | 229375 | 229394 |  |  |  |
| 1463608 | N/A | N/A | 225370 | 225389 | TTCCCTCTTTATTTCCTACT | 31 | 2645 |
| 1463620 | N/A | N/A | 221302 | 221321 | TAGTTATTACCTATGCCACT | 28 | 2646 |
| 1463622 | N/A | N/A | 233074 | 233093 | GTGCTTTTCCAACAAGTTCC | 30 | 2647 |
| 1463630 | N/A | N/A | 218917 | 218936 | GCCTAAATACATTTCTTTGC | 77 | 2648 |

TABLE 38

Reduction of APP RNA by 5-10-5 MOE gapmers with mixed PO/PS internucleoside linkages in A431 cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1397572 | N/A | N/A | 224068 | 224087 | TGGCAAACTCTCTTAGGTTC | 9 | 1733 |
| 1463172 | N/A | N/A | 220892 | 220911 | GCTTTTTTCTCTTCTTTTT | 9 | 2649 |
| 1463173 | N/A | N/A | 223714 | 223733 | TCTCCGTTCTCTATGCAAAT | 24 | 2650 |
| 1463175 | N/A | N/A | 234061 | 234080 | CTCCTTCCTTTTAATCAGA | 48 | 2651 |
| 1463185 | N/A | N/A | 220401 | 220420 | GCCAGATACATATTGCTTAT | 9 | 2652 |
| 1463186 | N/A | N/A | 220958 | 220977 | CTTCATAAATTCTTGCTCAA | 39 | 2653 |
| 1463188 | N/A | N/A | 221139 | 221158 | TTGGAGAACTTCTTTACACT | 11 | 2654 |
| 1463196 | N/A | N/A | 222745 | 222764 | ATTCCTTCTTCTCAGCATGA | 20 | 2655 |
| 1463197 | N/A | N/A | 220459 | 220478 | CCTGTATCTATTTCCAACCC | 39 | 2656 |
| 1463213 | N/A | N/A | 231655 | 231674 | CAGTCTTTAGTCTTATTCAT | 11 | 2657 |
| 1463214 | N/A | N/A | 231022 | 231041 | CCTCATCCTCTCAGCCCCTG | 51 | 2658 |
| 1463215 | N/A | N/A | 221563 | 221582 | AGTTATCTAAATATCCTCCC | 54 | 2659 |
| 1463229 | N/A | N/A | 220058 | 220077 | GACCTCTCTGTACTATTTTT | 38 | 2660 |
| 1463230 | N/A | N/A | 218625 | 218644 | CTCATTTTAGTCATTGGTTT | 39 | 2661 |
| 1463231 | N/A | N/A | 222762 | 222781 | TCCCCTTCACCGATAGCATT | 38 | 2662 |
| 1463238 | N/A | N/A | 226582 | 226601 | TCACACATTTGTATCTTGCT | 8 | 2663 |
| 1463247 | N/A | N/A | 222728 | 222747 | TGACTCCATTCTTCCTCATT | 56 | 2664 |
| 1463259 | N/A | N/A | 221090 | 221109 | TTACTGATGTCTATTCTCCA | 38 | 2665 |
| 1463261 | N/A | N/A | 222440 | 222459 | CTCTGAATTTAGTATGCTA | 18 | 2666 |
| 1463266 | N/A | N/A | 228278 | 228297 | TCTTCCTTTTTTGAGACAG | 11 | 2667 |
| 1463270 | N/A | N/A | 229211 | 229230 | GCCCTTGTTCCAGTCTAAAA | 47 | 2668 |
| 1463273 | N/A | N/A | 225701 | 225720 | ACCTAGTCTACTTTGGACCC | 84 | 2669 |
| 1463275 | N/A | N/A | 224105 | 224124 | CCCACTTTCATCACTTTACT | 65 | 2670 |

TABLE 38-continued

Reduction of APP RNA by 5-10-5 MOE gapmers with mixed PO/PS internucleoside linkages in A431 cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1463276 | N/A | N/A | 220747 | 220766 | TCTGCAAGTTATGTAGCTCA | 20 | 2671 |
| 1463279 | N/A | N/A | 233397 | 233416 | GCATTTTTTTCTATGAATT | 28 | 2672 |
| 1463280 | N/A | N/A | 221639 | 221658 | ACCCCCTAATATGTTCTTAA | 51 | 2673 |
| 1463287 | N/A | N/A | 219243 | 219262 | TGGTTCTTTTTCTTTCTTTT | 41 | 2674 |
| 1463290 | N/A | N/A | 222554 | 222573 | ACAGATGTTTGACTGCATTA | 19 | 2675 |
| 1463294 | N/A | N/A | 220898 | 220917 | GAAGTTGCTTTTTTCTCTT | 5 | 2676 |
| 1463295 | N/A | N/A | 220681 | 220700 | ACATCATCACTTGACACATG | 42 | 2677 |
| 1463303 | N/A | N/A | 234355 | 234374 | CTGCACTGATTCCTCTTTTT | 57 | 2678 |
| 1463308 | N/A | N/A | 231290 | 231309 | TCCTGTGTCCTTATTTCTTC | 14 | 2679 |
| 1463314 | N/A | N/A | 218642 | 218661 | ATACAACTTTTGTTTTTCTC | 48 | 2680 |
| 1463328 | N/A | N/A | 219710 | 219729 | GCATCATAATTTGAGAGCCA | 33 | 2681 |
| 1463329 | N/A | N/A | 224598 | 224617 | ATGCTTTGTTATCTTGGCCA | 39 | 2682 |
| 1463331 | N/A | N/A | 233907 | 233926 | GTTAGCATTTCCAGCCAACA | 78 | 2683 |
| 1463342 | N/A | N/A | 220973 | 220992 | CTCCACCTCCACTATCTTCA | 49 | 2684 |
| 1463345 | N/A | N/A | 222737 | 222756 | TTCTCAGCATGACTCCATTC | 45 | 2685 |
| 1463354 | N/A | N/A | 227156 | 227175 | GTTGATATTTAATTCCTCAA | 11 | 2686 |
| 1463356 | N/A | N/A | 231283 | 231302 | TCCTTATTTCTTCAATCTCC | 22 | 2687 |
| 1463365 | N/A | N/A | 222637 | 222656 | ACTGGCAGTTCCCCAGACTG | 79 | 2688 |
| 1463379 | N/A | N/A | 222459 | 222478 | TTTCTCCTTTTGCCAGTGTC | 9 | 2689 |
| 1463386 | N/A | N/A | 220237 | 220256 | GTATTTTATTCTCTTTCCAA | 13 | 2690 |
| 1463389 | N/A | N/A | 220262 | 220281 | TTGGCAGCTGACAGAGACTC | 26 | 2691 |
| 1463395 | N/A | N/A | 233131 | 233150 | GCTCAGCCCCATCCCTAGCT | 108 | 2692 |
| 1463401 | N/A | N/A | 221273 | 221292 | GTCACATGTGAAAACAGGCT | 23 | 2693 |
| 1463414 | N/A N/A | N/A N/A | 229343 229376 | 229362 229395 | AACATATTTCAAAATTAATC | 57 | 2694 |
| 1463438 | N/A | N/A | 223842 | 223861 | ACATCTCTATATGGCGGTCC | 22 | 2695 |
| 1463443 | N/A | N/A | 224215 | 224234 | ACCCAGTGCTTTCACATTGA | 21 | 2696 |
| 1463448 | N/A | N/A | 233435 | 233454 | TTCACCTTTTAATCTACAAC | 38 | 2697 |
| 1463453 | N/A | N/A | 222783 | 222802 | TCACAAATTTAATGTCAATT | 68 | 2698 |
| 1463454 | N/A | N/A | 221317 | 221336 | TGGCTTATTTCCCTATAGTT | 12 | 2699 |
| 1463458 | N/A | N/A | 219056 | 219075 | TCTCTAACTTTTTGAGCTCA | 68 | 2700 |
| 1463460 | N/A | N/A | 234328 | 234347 | GTTTCTTATTTTTTCAGTTT | 8 | 2701 |
| 1463463 | N/A | N/A | 225365 | 225384 | TCTTTATTTCCTACTGCCTT | 47 | 2702 |
| 1463486 | N/A | N/A | 221306 | 221325 | CCTATAGTTATTACCTATGC | 54 | 2703 |
| 1463491 | N/A | N/A | 234565 | 234584 | CCCACTTAATTTTTCATCCT | 34 | 2704 |
| 1463494 | N/A | N/A | 229286 | 229305 | ATCACTGATTTTTTCCCCT | 19 | 2705 |

TABLE 38-continued

Reduction of APP RNA by 5-10-5 MOE gapmers with mixed PO/PS internucleoside linkages in A431 cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1463505 | N/A | N/A | 222528 | 222547 | TCCTAATTGCTTGTATTTAT | 27 | 2706 |
| 1463508 | N/A | N/A | 221874 | 221893 | GCATCTGGTATATTTAGAAT | 9 | 2707 |
| 1463511 | N/A | N/A | 220051 | 220070 | CTGTACTATTTTCCAAGTT | 7 | 2708 |
| 1463518 | N/A | N/A | 222006 | 222025 | ACTAGCAGCTCAGATAGTGT | 80 | 2709 |
| 1463527 | N/A | N/A | 222715 | 222734 | CCTCATTTTCACCCATAAAA | 40 | 2710 |
| 1463530 | N/A | N/A | 219085 | 219104 | CTTTATTTTTCTTGTTCTCC | 155 | 2711 |
| 1463531 | N/A | N/A | 232176 | 232195 | GCCACTAACATGCCATCTGC | 46 | 2712 |
| 1463542 | N/A | N/A | 221343 | 221362 | GTCATCAACTTTTAGTCCT | 8 | 2713 |
| 1463545 | N/A | N/A | 221081 | 221100 | TCTATTCTCCAAGTATACCT | 33 | 2714 |
| 1463547 | N/A | N/A | 225371 | 225390 | GTTCCCTCTTTATTTCCTAC | 16 | 2715 |
| 1463565 | N/A | N/A | 222722 | 222741 | CATTCTTCCTCATTTTCACC | 50 | 2716 |
| 1463575 | N/A | N/A | 234808 | 234827 | ATTCCACTTTCATGTTCCCT | 10 | 2717 |
| 1463576 | N/A N/A | N/A N/A | 229345 229378 | 229364 229397 | GAAACATATTTCAAAATTAA | 93 | 2718 |
| 1463590 | N/A | N/A | 220485 | 220504 | CTGGGTGCTCTGATTCCAGA | 81 | 2719 |
| 1463591 | N/A | N/A | 231066 | 231085 | GCCAAATTGAACCTCTGTGC | 15 | 2720 |
| 1463593 | N/A | N/A | 228947 | 228966 | CATGCCTCAGGCTCCATCCA | 90 | 2721 |
| 1463602 | N/A | N/A | 219949 | 219968 | CACTCATGGCTTCCCTGCTC | 37 | 2722 |
| 1463615 | N/A | N/A | 222754 | 222773 | ACCGATAGCATTCCTTCTTC | 29 | 2723 |
| 1463623 | N/A | N/A | 222139 | 222158 | TTTCAACTATATTCCTACTA | 55 | 2724 |
| 1463629 | N/A | N/A | 225469 | 225488 | GCCAGAGATCTTTCCCGCAT | 26 | 2725 |

TABLE 39

Reduction of APP RNA by 5-10-5 MOE gapmers with mixed PO/PS internucleoside linkages in A431 cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1397572 | N/A | N/A | 224068 | 224087 | TGGCAAACTCTCTTAGGTTC | 4 | 1733 |
| 1463177 | N/A | N/A | 223844 | 223863 | CCACATCTCTATATGGCGGT | 14 | 2726 |
| 1463178 | N/A | N/A | 225366 | 225385 | CTCTTTATTTCCTACTGCCT | 22 | 2727 |
| 1463204 | N/A | N/A | 220402 | 220421 | TGCCAGATACATATTGCTTA | 20 | 2728 |
| 1463205 | N/A | N/A | 222738 | 222757 | CTTCTCAGCATGACTCCATT | 48 | 2729 |
| 1463208 | N/A | N/A | 229407 | 229426 | ACTCATGTCATTCCCAGTTA | 17 | 2730 |
| 1463209 | N/A | N/A | 222716 | 222735 | TCCTCATTTTCACCCATAAA | 48 | 2731 |
| 1463216 | N/A | N/A | 222747 | 222766 | GCATTCCTTCTTCTCAGCAT | 22 | 2732 |
| 1463224 | N/A | N/A | 221082 | 221101 | GTCTATTCTCCAAGTATACC | 14 | 2733 |

TABLE 39-continued

Reduction of APP RNA by 5-10-5 MOE gapmers with mixed PO/PS internucleoside linkages in A431 cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1463232 | N/A | N/A | 229215 | 229234 | ACCAGCCCTTGTTCCAGTCT | 31 | 2734 |
| 1463244 | N/A | N/A | 231284 | 231303 | GTCCTTATTTCTTCAATCTC | 18 | 2735 |
| 1463246 | N/A | N/A | 221308 | 221327 | TCCCTATAGTTATTACCTAT | 26 | 2736 |
| 1463251 | N/A | N/A | 219991 | 220010 | CCCACTATCTTTTAAGTTTA | 63 | 2737 |
| 1463262 | N/A | N/A | 221641 | 221660 | GCACCCCTAATATGTTCTT | 28 | 2738 |
| 1463263 | N/A | N/A | 221474 | 221493 | ACCACCATCTGTTCTGTGGA | 56 | 2739 |
| 1463268 | N/A | N/A | 222414 | 222433 | CTGAACTGACTCCAAATCTA | 34 | 2740 |
| 1463282 | N/A | N/A | 234062 | 234081 | TCTCCTTCCTTTTAATCAG | 49 | 2741 |
| 1463292 | N/A | N/A | 234344 | 234363 | CCTCTTTTCTCTAAAGTTT | 22 | 2742 |
| 1463315 | N/A | N/A | 224108 | 224127 | CACCCCACTTTCATCACTTT | 40 | 2743 |
| 1463319 | N/A | N/A | 233398 | 233417 | TGCATTTTTTTCTATGAAT | 35 | 2744 |
| 1463322 | N/A | N/A | 228286 | 228305 | AGTCTTTTTCTTCCTTTTT | 15 | 2745 |
| 1463334 | N/A | N/A | 231786 | 231805 | TTTCTTCTATCTACCGCATT | 35 | 2746 |
| 1463344 | N/A | N/A | 229287 | 229306 | CATCACTGATTTTTTCCCC | 16 | 2747 |
| 1463349 | N/A | N/A | 221149 | 221168 | CTACAACTTTTGGAGAACT | 14 | 2748 |
| 1463352 | N/A | N/A | 233439 | 233458 | GTTGTTCACCTTTTAATCTA | 13 | 2749 |
| 1463362 | N/A | N/A | 231101 | 231120 | CCATCCATCTTCCCCACTGA | 49 | 2750 |
| 1463363 | N/A | N/A | 223716 | 223735 | TTTCTCCGTTCTCTATGCAA | 45 | 2751 |
| 1463373 | N/A | N/A | 220503 | 220522 | ACATCCATCTACAACATCCT | 41 | 2752 |
| 1463374 | N/A | N/A | 220900 | 220919 | ATGAAGTTGCTTTTTTCTC | 16 | 2753 |
| 1463376 | N/A | N/A | 222441 | 222460 | TCTCTGAATTTTAGTATGCT | 16 | 2754 |
| 1463378 | N/A | N/A | 220964 | 220983 | CACTATCTTCATAAATTCTT | 70 | 2755 |
| 1463383 | N/A | N/A | 220766 | 220785 | CCTGACATATGAAGTTTCTT | 78 | 2756 |
| 1463388 | N/A | N/A | 220893 | 220912 | TGCTTTTTTCTCTTCTTTT | 4 | 2757 |
| 1463391 | N/A | N/A | 226583 | 226602 | TTCACACATTTGTATCTTGC | 11 | 2758 |
| 1463393 | N/A | N/A | 221610 | 221629 | ATGGCTGTTTTTTTTTTCT | 23 | 2759 |
| 1463394 | N/A | N/A | 220239 | 220258 | TGGTATTTATTCTCTTTCC | 6 | 2760 |
| 1463398 | N/A | N/A | 224607 | 224626 | CCCTGATTATGCTTTGTTA | 22 | 2761 |
| 1463403 | N/A | N/A | 232190 | 232209 | GCCAGCAGCAACAGGCCACT | 86 | 2762 |
| 1463410 | N/A | N/A | 218626 | 218645 | TCTCATTTAGTCATTGGTT | 20 | 2763 |
| 1463412 | N/A | N/A | 220067 | 220086 | GATGCATGAGACCTCTCTGT | 60 | 2764 |
| 1463421 | N/A | N/A | 219069 | 219088 | CTCCTATTTCTGTTCTCTAA | 90 | 2765 |
| 1463424 | N/A | N/A | 222764 | 222783 | TTTCCCCTTCACCGATAGCA | 15 | 2766 |
| 1463431 | N/A | N/A | 234567 | 234586 | GTCCCACTTAATTTTTCATC | 41 | 2767 |
| 1463434 | N/A | N/A | 234357 | 234376 | GCCTGCACTGATTCCTCTTT | 42 | 2768 |
| 1463437 | N/A | N/A | 222015 | 222034 | AGCTTTGACACTAGCAGCTC | 73 | 2769 |

TABLE 39-continued

Reduction of APP RNA by 5-10-5 MOE gapmers with mixed PO/PS internucleoside linkages in A431 cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1463439 | N/A | N/A | 219086 | 219105 | ACTTTATTTTCTTGTTCTC | 38 | 2770 |
| 1463441 | N/A | N/A | 234897 | 234916 | TTGACCATTTTTAGCACTTT | 20 | 2771 |
| 1463445 | N/A | N/A | 220368 | 220387 | ACACACTAAATCTCCAGTAT | 28 | 2772 |
| 1463449 | N/A | N/A | 225805 | 225824 | GTTCATCCTTGACTAACAAT | 14 | 2773 |
| 1463451 | N/A | N/A | 219746 | 219765 | ATGAGTTTTTTCCCCATTA | 8 | 2774 |
| 1463455 | N/A | N/A | 221318 | 221337 | ATGGCTTATTTCCCTATAGT | 8 | 2775 |
| 1463456 | N/A | N/A | 220974 | 220993 | ACTCCACCTCCACTATCTTC | 64 | 2776 |
| 1463461 | N/A | N/A | 229344 | 229363 | AAACATATTTCAAAATTAAT | 121 | 2777 |
|  | N/A | N/A | 229377 | 229396 |  |  |  |
| 1463462 | N/A | N/A | 225531 | 225550 | GCGAATTTCTTGATTCCCCG | 12 | 2778 |
| 1463475 | N/A | N/A | 222485 | 222504 | GCATGCATTTTTAGGGACTT | 23 | 2779 |
| 1463484 | N/A | N/A | 222663 | 222682 | GCAGATATACCTCTCCCACT | 22 | 2780 |
| 1463492 | N/A | N/A | 221965 | 221984 | TTCTCTTTCTATAGAGAACA | 74 | 2781 |
| 1463495 | N/A | N/A | 219244 | 219263 | ATGGTTCTTTTTCTTTCTTT | 50 | 2782 |
| 1463497 | N/A | N/A | 220710 | 220729 | CCGTCCATTAATGTGCAGTA | 5 | 2783 |
| 1463502 | N/A | N/A | 233924 | 233943 | ACCCAAGTTTCTTACAAGTT | 25 | 2784 |
| 1463509 | N/A | N/A | 222533 | 222552 | GCACATCCTAATTGCTTGTA | 8 | 2785 |
| 1463520 | N/A | N/A | 221091 | 221110 | CTTACTGATGTCTATTCTCC | 38 | 2786 |
| 1463525 | N/A | N/A | 225372 | 225391 | TGTTCCCTCTTTATTTCCTA | 11 | 2787 |
| 1463533 | N/A | N/A | 231291 | 231310 | ATCCTGTGTCCTTATTTCTT | 19 | 2788 |
| 1463539 | N/A | N/A | 222755 | 222774 | CACCGATAGCATTCCTTCTT | 40 | 2789 |
| 1463543 | N/A | N/A | 220052 | 220071 | TCTGTACTATTTTCCAAGT | 14 | 2790 |
| 1463544 | N/A | N/A | 222723 | 222742 | CCATTCTTCCTCATTTTCAC | 36 | 2791 |
| 1463551 | N/A | N/A | 220460 | 220479 | ACCTGTATCTATTTCCAACC | 34 | 2792 |
| 1463566 | N/A | N/A | 222784 | 222803 | CTCACAAATTTAATGTCAAT | 39 | 2793 |
| 1463569 | N/A | N/A | 228951 | 228970 | AGACCATGCCTCAGGCTCCA | 59 | 2794 |
| 1463570 | N/A | N/A | 224415 | 224434 | GCATCTGCCTTTTTATCCTG | 14 | 2795 |
| 1463571 | N/A | N/A | 233239 | 233258 | TCTCACCTATTTATTAACTT | 42 | 2796 |
| 1463574 | N/A | N/A | 231023 | 231042 | CCCTCATCCTCTCAGCCCCT | 74 | 2797 |
| 1463592 | N/A | N/A | 221287 | 221306 | CCACTTCAACTGAAGTCACA | 82 | 2798 |
| 1463599 | N/A | N/A | 222560 | 222579 | CTCTCTACAGATGTTTGACT | 28 | 2799 |
| 1463616 | N/A | N/A | 228103 | 228122 | GCCATGTTTCCCATTCTGGT | 48 | 2800 |
| 1463617 | N/A | N/A | 218681 | 218700 | GCCATACTTCAGTTGAACCA | 50 | 2801 |
| 1463633 | N/A | N/A | 222729 | 222748 | ATGACTCCATTCTTCCTCAT | 35 | 2802 |

TABLE 40

Reduction of APP RNA by 5-10-5 MOE gapmers with mixed PO/PS internucleoside linkages in A431 cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1397572 | N/A | N/A | 224068 | 224087 | TGGCAAACTCTCTTAGGTTC | 6 | 1733 |
| 1397795 | N/A | N/A | 222488 | 222507 | AAGGCATGCATTTTTAGGGA | 7 | 2277 |
| 1463187 | N/A | N/A | 222757 | 222776 | TTCACCGATAGCATTCCTTC | 51 | 2803 |
| 1463192 | N/A | N/A | 220894 | 220913 | TTGCTTTTTTCTCTTCTTT | 8 | 2804 |
| 1463193 | N/A | N/A | 221966 | 221985 | CTTCTCTTTCTATAGAGAAC | 66 | 2805 |
| 1463199 | N/A | N/A | 220028 | 220047 | GTGAGAGTACAATTATTTCA | 5 | 2806 |
| 1463202 | N/A | N/A | 233400 | 233419 | CATGCATTTTTTTCTATGA | 11 | 2807 |
| 1463203 | N/A | N/A | 220240 | 220259 | GTGGTATTTTATTCTCTTTC | 4 | 2808 |
| 1463211 | N/A | N/A | 229569 | 229588 | CCTTCTATGATTTACTTTCT | 35 | 2809 |
| 1463217 | N/A | N/A | 222826 | 222845 | TCACAAGCATGATGAACCCT | 104 | 2810 |
| 1463222 | N/A | N/A | 222717 | 222736 | TTCCTCATTTTCACCCATAA | 47 | 2811 |
| 1463223 | N/A | N/A | 220712 | 220731 | TTCCGTCCATTAATGTGCAG | 23 | 2812 |
| 1463227 | N/A | N/A | 233778 | 233797 | GCACATCATTTACCCTTTAA | 6 | 2813 |
| 1463233 | N/A | N/A | 221289 | 221308 | TGCCACTTCAACTGAAGTCA | 39 | 2814 |
| 1463235 | N/A | N/A | 218631 | 218650 | GTTTTTCTCATTTTAGTCAT | 76 | 2815 |
| 1463236 | N/A | N/A | 234590 | 234609 | TGCGATTTAGTAATTCACAA | 6 | 2816 |
| 1463239 | N/A | N/A | 221084 | 221103 | ATGTCTATTCTCCAAGTATA | 28 | 2817 |
| 1463242 | N/A | N/A | 224113 | 224132 | GCTTCCACCCCACTTTCATC | 47 | 2818 |
| 1463243 | N/A | N/A | 222534 | 222553 | AGCACATCCTAATTGCTTGT | 37 | 2819 |
| 1463245 | N/A | N/A | 220461 | 220480 | AACCTGTATCTATTTCCAAC | 35 | 2820 |
| 1463256 | N/A | N/A | 234898 | 234917 | CTTGACCATTTTTAGCACTT | 15 | 2821 |
| 1463271 | N/A | N/A | 224608 | 224627 | ACCCTGATTTATGCTTTGTT | 16 | 2822 |
| 1463277 | N/A | N/A | 221157 | 221176 | TGTACCTTCTACAACTTTTT | 19 | 2823 |
| 1463296 | N/A | N/A | 226652 | 226671 | CCTGCAGGTCTGTAACCTCA | 107 | 2824 |
| 1463298 | N/A | N/A | 228106 | 228125 | CTTGCCATGTTTCCCATTCT | 52 | 2825 |
| 1463300 | N/A | N/A | 232203 | 232222 | GTATGATTTAATAGCCAGCA | 21 | 2826 |
| 1463306 | N/A | N/A | 220070 | 220089 | ATGGATGCATGAGACCTCTC | 63 | 2827 |
| 1463313 | N/A | N/A | 234350 | 234369 | CTGATTCCTCTTTTTCTCTA | 10 | 2828 |
| 1463332 | N/A | N/A | 222730 | 222749 | CATGACTCCATTCTTCCTCA | 23 | 2829 |
| 1463333 | N/A | N/A | 222739 | 222758 | TCTTCTCAGCATGACTCCAT | 37 | 2830 |
| 1463347 | N/A | N/A | 220967 | 220986 | CTCCACTATCTTCATAAATT | 61 | 2831 |
| 1463351 | N/A | N/A | 229324 | 229343 | CTCAATTTGGATTCATCTCC | 25 | 2832 |
| 1463355 | N/A | N/A | 221488 | 221507 | TTCAAGATATCTGAACCACC | 14 | 2833 |
| 1463367 | N/A | N/A | 220929 | 220948 | GCTCCTTCTGAACAAAGCT | 52 | 2834 |
| 1463368 | N/A | N/A | 225532 | 225551 | TGCGATTTCTTGATTCCCC | 7 | 2835 |
| 1463375 | N/A | N/A | 229098 | 229117 | CTGACTTCACTTCCCAATCA | 43 | 2836 |

TABLE 40-continued

Reduction of APP RNA by 5-10-5 MOE gapmers with mixed PO/PS internucleoside linkages in A431 cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1463377 | N/A | N/A | 219183 | 219202 | GGTTATTTTTCTTACCAAGC | 43 | 2837 |
| 1463382 | N/A | N/A | 233250 | 233269 | CTACAATGGATTCTCACCTA | 36 | 2838 |
| 1463385 | N/A | N/A | 231444 | 231463 | GCTTCTTAACTGTTTATCCA | 32 | 2839 |
| 1463396 | N/A | N/A | 221631 | 221650 | ATATGTTCTTAATCCAACCT | 43 | 2840 |
| 1463416 | N/A | N/A | 223720 | 223739 | CTCTTTTCTCCGTTCTCTAT | 17 | 2841 |
| 1463417 | N/A | N/A | 225377 | 225396 | GCCTTTGTTCCCTCTTTATT | 20 | 2842 |
| 1463422 | N/A | N/A | 225367 | 225386 | CCTCTTTATTTCCTACTGCC | 30 | 2843 |
| 1463425 | N/A | N/A | 221322 | 221341 | TGTAATGGCTTATTTCCCTA | 9 | 2844 |
| 1463429 | N/A | N/A | 218682 | 218701 | TGCCATACTTCAGTTGAACC | 50 | 2845 |
| 1463432 | N/A | N/A | 224416 | 224435 | AGCATCTGCCTTTTTATCCT | 20 | 2846 |
| 1463433 | N/A | N/A | 222442 | 222461 | GTCTCTGAATTTTAGTATGC | 14 | 2847 |
| 1463446 | N/A | N/A | 221002 | 221021 | TGTTCTCAATTCATGGTGTA | 12 | 2848 |
| 1463447 | N/A | N/A | 220505 | 220524 | GTACATCCATCTACAACATC | 47 | 2849 |
| 1463450 | N/A | N/A | 228768 | 228787 | CAGTTCTCTTGCTACTTCTA | 10 | 2850 |
| 1463459 | N/A | N/A | 222664 | 222683 | AGCAGATATACCTCTCCCAC | 30 | 2851 |
| 1463465 | 1693 | 1712 | 219383 | 219402 | CCTGAATCTCCTCGGCCACT | 26 | 2852 |
| 1463474 | N/A | N/A | 221643 | 221662 | CTGCACCCCTAATATGTTC | 27 | 2853 |
| 1463479 | N/A | N/A | 220054 | 220073 | TCTCTGTACTATTTTCCAA | 27 | 2854 |
| 1463481 | N/A | N/A | 222770 | 222789 | GTCAATTTTCCCCTTCACCG | 12 | 2855 |
| 1463485 | N/A | N/A | 222564 | 222583 | GTATCTCTCTACAGATGTTT | 7 | 2856 |
| 1463501 | N/A | N/A | 231025 | 231044 | GTCCCTCATCCTCTCAGCCC | 31 | 2857 |
| 1463503 | N/A | N/A | 225847 | 225866 | GTGACAGCTCTCTATTTGCT | 28 | 2858 |
| 1463510 | N/A | N/A | 222424 | 222443 | GCTATTTGTACTGAACTGAC | 12 | 2859 |
| 1463513 | N/A | N/A | 233939 | 233958 | GCTTAAACCATTTCCACCCA | 37 | 2860 |
| 1463517 | N/A | N/A | 219070 | 219089 | TCTCCTATTTCTGTTCTCTA | 84 | 2861 |
| 1463519 | N/A | N/A | 221309 | 221328 | TTCCCTATAGTTATTACCTA | 55 | 2862 |
| 1463523 | N/A | N/A | 231789 | 231808 | ACATTTCTTCTATCTACCGC | 28 | 2863 |
| 1463537 | N/A | N/A | 231285 | 231304 | TGTCCTTATTTCTTCAATCT | 21 | 2864 |
| 1463550 | N/A | N/A | 229282 | 229301 | CTGATTTTTTCCCCTCCTC | 30 | 2865 |
| 1463555 | N/A | N/A | 220407 | 220426 | GGATATGCCAGATACATATT | 22 | 2866 |
| 1463556 | N/A | N/A | 234131 | 234150 | ACTTTATTTTGACTGACATC | 22 | 2867 |
| 1463557 | N/A | N/A | 222724 | 222743 | TCCATTCTTCCTCATTTTCA | 28 | 2868 |
| 1463561 | N/A N/A | N/A N/A | 229346 229379 | 229365 229398 | GGAAACATATTTCAAAATTA | 45 | 2869 |
| 1463573 | N/A | N/A | 234358 | 234377 | AGCCTGCACTGATTCCTCTT | 47 | 2870 |
| 1463581 | N/A | N/A | 222016 | 222035 | TAGCTTTGACACTAGCAGCT | 53 | 2871 |
| 1463583 | N/A | N/A | 222748 | 222767 | AGCATTCCTTCTTCTCAGCA | 17 | 2872 |

TABLE 40-continued

Reduction of APP RNA by 5-10-5 MOE gapmers with mixed PO/PS internucleoside linkages in A431 cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1463585 | N/A | N/A | 231102 | 231121 | GCCATCCATCTTCCCCACTG | 56 | 2873 |
| 1463600 | N/A | N/A | 220371 | 220390 | ACTACACACTAAATCTCCAG | 25 | 2874 |
| 1463603 | N/A | N/A | 220769 | 220788 | CTCCCTGACATATGAAGTTT | 73 | 2875 |
| 1463609 | N/A | N/A | 219940 | 219959 | CTTCCCTGCTCAGCCATCAA | 59 | 2876 |
| 1463614 | N/A | N/A | 221092 | 221111 | CCTTACTGATGTCTATTCTC | 38 | 2877 |
| 1463632 | N/A | N/A | 223845 | 223864 | GCCACATCTCTATATGGCGG | 73 | 2878 |

TABLE 41

Reduction of APP RNA by 5-10-5 MOE gapmers with mixed PO/PS internucleoside linkages in A431 cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1397572 | N/A | N/A | 224068 | 224087 | TGGCAAACTCTCTTAGGTTC | 5 | 1733 |
| 1463176 | N/A | N/A | 221323 | 221342 | TTGTAATGGCTTATTTCCCT | 9 | 2879 |
| 1463180 | N/A | N/A | 221732 | 221751 | TCTTTATTTTTATTATACTT | 73 | 2880 |
| 1463184 | N/A | N/A | 231105 | 231124 | ACGGCCATCCATCTTCCCCA | 57 | 2881 |
| 1463190 | N/A | N/A | 221158 | 221177 | TTGTACCTTCTACAACTTTT | 22 | 2882 |
| 1463207 | N/A | N/A | 229339 | 229358 | TATTTCAAAATTAATCTCAA | 110 | 2883 |
|  | N/A | N/A | 229372 | 229391 |  |  |  |
| 1463210 | N/A | N/A | 221296 | 221315 | TTACCTATGCCACTTCAACT | 56 | 2884 |
| 1463219 | N/A | N/A | 229652 | 229671 | GTCAACATTCCTTTGGACAC | 71 | 2885 |
| 1463221 | N/A | N/A | 221635 | 221654 | CCTAATATGTTCTTAATCCA | 40 | 2886 |
| 1463234 | N/A | N/A | 224121 | 224140 | AGGTCTTGGCTTCCACCCCA | 72 | 2887 |
| 1463240 | N/A | N/A | 222959 | 222978 | GCACTGGGATTCAGTACGCT | 40 | 2888 |
| 1463241 | N/A | N/A | 218687 | 218706 | TTGCCTGCCATACTTCAGTT | 70 | 2889 |
| 1463248 | N/A | N/A | 221004 | 221023 | TCTGTTCTCAATTCATGGTG | 8 | 2890 |
| 1463250 | N/A | N/A | 220127 | 220146 | CTGGTTTTGATAATGGACTA | 36 | 2891 |
| 1463253 | N/A | N/A | 225293 | 225312 | GCTACATTTTAGCCTTGAG | 11 | 2892 |
| 1463255 | N/A | N/A | 222758 | 222777 | CTTCACCGATAGCATTCCTT | 42 | 2893 |
| 1463257 | N/A | N/A | 234185 | 234204 | GCTTCAAGCATTCTCAGTAT | 19 | 2894 |
| 1463258 | N/A | N/A | 220773 | 220792 | GCACCTCCCTGACATATGAA | 32 | 2895 |
| 1463281 | N/A | N/A | 221310 | 221329 | TTTCCCTATAGTTATTACCT | 54 | 2896 |
| 1463284 | N/A | N/A | 218632 | 218651 | TGTTTTCTCATTTTAGTCA | 22 | 2897 |
| 1463301 | N/A | N/A | 220456 | 220475 | GTATCTATTTCCAACCCAAT | 27 | 2898 |
| 1463304 | N/A | N/A | 222427 | 222446 | TATGCTATTTGTACTGAACT | 27 | 2899 |
| 1463307 | N/A | N/A | 220048 | 220067 | TACTATTTTCCAAGTTCTT | 9 | 2900 |

TABLE 41-continued

Reduction of APP RNA by 5-10-5 MOE gapmers with mixed PO/PS internucleoside linkages in A431 cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1463312 | N/A | N/A | 222725 | 222744 | CTCCATTCTTCCTCATTTTC | 40 | 2901 |
| 1463318 | N/A | N/A | 234361 | 234380 | CCTAGCCTGCACTGATTCCT | 65 | 2902 |
| 1463320 | N/A | N/A | 220055 | 220074 | CTCTCTGTACTATTTTTCCA | 37 | 2903 |
| 1463325 | 1700 | 1719 | 219390 | 219409 | ACTTCATCCTGAATCTCCTC | 43 | 2904 |
| 1463326 | N/A | N/A | 233971 | 233990 | TCTGACATTTTCACTGATCG | 16 | 2905 |
| 1463327 | N/A | N/A | 225875 | 225894 | GTCACACCTATGTTCTTATA | 14 | 2906 |
| 1463330 | N/A | N/A | 222741 | 222760 | CTTCTTCTCAGCATGACTCC | 36 | 2907 |
| 1463339 | N/A | N/A | 234351 | 234370 | ACTGATTCCTCTTTTTCTCT | 14 | 2908 |
| 1463341 | N/A | N/A | 234983 | 235002 | ACATCTGATTTTTGCACCCC | 16 | 2909 |
| 1463348 | N/A | N/A | 222718 | 222737 | CTTCCTCATTTTCACCCATA | 32 | 2910 |
| 1463350 | N/A | N/A | 221086 | 221105 | TGATGTCTATTCTCCAAGTA | 40 | 2911 |
| 1463353 | N/A | N/A | 231286 | 231305 | GTGTCCTTATTTCTTCAATC | 9 | 2912 |
| 1463366 | N/A | N/A | 233780 | 233799 | TTGCACATCATTTACCCTTT | 7 | 2913 |
| 1463369 | N/A | N/A | 222731 | 222750 | GCATGACTCCATTCTTCCTC | 9 | 2914 |
| 1463387 | N/A | N/A | 226791 | 226810 | GCACTATATTTACAGATTCC | 6 | 2915 |
| 1463390 | N/A | N/A | 222052 | 222071 | CCCAGAAAAGCTATTCTCCC | 73 | 2916 |
| 1463392 | N/A | N/A | 231613 | 231632 | ACATGGTTTTCCTGAGCCTA | 41 | 2917 |
| 1463411 | N/A | N/A | 233401 | 233420 | GCATGCATTTTTTTTCTATG | 48 | 2918 |
| 1463413 | N/A | N/A | 222543 | 222562 | ACTGCATTAAGCACATCCTA | 32 | 2919 |
| 1463418 | N/A | N/A | 220932 | 220951 | GTTGCTCCTTCTGAACAAAA | 9 | 2920 |
| 1463419 | N/A | N/A | 225547 | 225566 | GCATCCTTTCATTATTGCGA | 34 | 2921 |
| 1463423 | N/A | N/A | 231030 | 231049 | CCACAGTCCCTCATCCTCTC | 37 | 2922 |
| 1463430 | N/A | N/A | 232567 | 232586 | ACGCAAAATTCTCTGCTGCC | 32 | 2923 |
| 1463435 | N/A | N/A | 233251 | 233270 | GCTACAATGGATTCTCACCT | 22 | 2924 |
| 1463440 | N/A | N/A | 222771 | 222790 | TGTCAATTTTCCCCTTCACC | 9 | 2925 |
| 1463442 | N/A | N/A | 221972 | 221991 | TGCAAACTTCTCTTTCTATA | 8 | 2926 |
| 1463467 | N/A | N/A | 222751 | 222770 | GATAGCATTCCTTCTTCTCA | 25 | 2927 |
| 1463471 | N/A | N/A | 224441 | 224460 | CCCACTTCATCAGTCCAAGT | 13 | 2928 |
| 1463472 | N/A | N/A | 220725 | 220744 | GTATAATTTCAGATTCCGTC | 7 | 2929 |
| 1463478 | N/A | N/A | 223721 | 223740 | GCTCTTTTCTCCGTTCTCTA | 5 | 2930 |
| 1463482 | N/A | N/A | 220379 | 220398 | GTTGGTAGACTACACACTAA | 9 | 2931 |
| 1463498 | N/A | N/A | 220895 | 220914 | GTTGCTTTTTTCTCTTCTT | 5 | 2932 |
| 1463499 | N/A | N/A | 222570 | 222589 | ACCATTGTATCTCTCTACAG | 13 | 2933 |
| 1463504 | N/A | N/A | 221489 | 221508 | ATTCAAGATATCTGAACCAC | 27 | 2934 |
| 1463514 | N/A | N/A | 234592 | 234611 | GTTGCGATTAGTAATTCAC | 5 | 2935 |
| 1463538 | N/A | N/A | 219071 | 219090 | TTCTCCTATTTCTGTTCTCT | 71 | 2936 |

TABLE 41-continued

Reduction of APP RNA by 5-10-5 MOE gapmers with mixed PO/PS internucleoside linkages in A431 cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1463548 | N/A | N/A | 220507 | 220526 | GGGTACATCCATCTACAACA | 18 | 2937 |
| 1463552 | N/A | N/A | 225368 | 225387 | CCCTCTTTATTTCCTACTGC | 27 | 2938 |
| 1463553 | N/A | N/A | 220241 | 220260 | TGTGGTATTTTATTCTCTTT | 4 | 2939 |
| 1463560 | N/A | N/A | 225379 | 225398 | ATGCCTTTGTTCCCTCTTTA | 9 | 2940 |
| 1463562 | N/A | N/A | 229283 | 229302 | ACTGATTTTTTCCCCTCCT | 12 | 2941 |
| 1463563 | N/A | N/A | 221097 | 221116 | AGGTTCCTTACTGATGTCTA | 11 | 2942 |
| 1463584 | N/A | N/A | 222665 | 222684 | AAGCAGATATACCTCTCCCA | 19 | 2943 |
| 1463586 | N/A | N/A | 220968 | 220987 | CCTCCACTATCTTCATAAAT | 110 | 2944 |
| 1463588 | N/A | N/A | 219941 | 219960 | GCTTCCCTGCTCAGCCATCA | 37 | 2945 |
| 1463598 | N/A | N/A | 219187 | 219206 | CCCAGGTTATTTTCTTACC | 74 | 2946 |
| 1463604 | N/A | N/A | 223983 | 224002 | CCCATATGCTGCCTTTGTGT | 18 | 2947 |
| 1463607 | N/A | N/A | 228107 | 228126 | TCTTGCCATGTTTCCCATTC | 31 | 2948 |
| 1463610 | N/A | N/A | 222506 | 222525 | GCACAAACTTCTATACAAAA | 11 | 2949 |
| 1463612 | N/A | N/A | 222444 | 222463 | GTGTCTCTGAATTTTAGTAT | 7 | 2950 |
| 1463613 | N/A | N/A | 231790 | 231809 | GACATTTCTTCTATCTACCG | 30 | 2951 |
| 1463618 | N/A | N/A | 229102 | 229121 | TGGTCTGACTTCACTTCCCA | 62 | 2952 |
| 1463619 | N/A | N/A | 220477 | 220496 | TCTGATTCCAGATGATAACC | 58 | 2953 |
| 1463624 | N/A | N/A | 229325 | 229344 | TCTCAATTTGGATTCATCTC | 25 | 2954 |
| 1463628 | N/A | N/A | 228937 | 228956 | GCTCCATCCATTTGGTTGAG | 63 | 2955 |

TABLE 42

Reduction of APP RNA by 5-10-5 MOE gapmers with mixed PO/PS internucleoside linkages in A431 cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1397572 | N/A | N/A | 224068 | 224087 | TGGCAAACTCTCTTAGGTTC | 7 | 1733 |
| 1399436 | N/A | N/A | 221519 | 221538 | GTGCTGCCCTATTCTTGGGC | 58 | 1881 |
| 1463182 | N/A | N/A | 222668 | 222687 | CTGAAGCAGATATACCTCTC | 37 | 2956 |
| 1463183 | N/A | N/A | 221124 | 221143 | ACACTTATTTAATACATAGT | 37 | 2957 |
| 1463189 | N/A | N/A | 226832 | 226851 | GTCATTATCAATGACTTCCA | 81 | 2958 |
| 1463191 | N/A | N/A | 222546 | 222565 | TTGACTGCATTAAGCACATC | 66 | 2959 |
| 1463195 | N/A | N/A | 220732 | 220751 | GCTCAAAGTATAATTTCAGA | 11 | 2960 |
| 1463198 | N/A | N/A | 221973 | 221992 | TTGCAAACTTCTCTTTCTAT | 20 | 2961 |
| 1463201 | N/A | N/A | 220970 | 220989 | CACCTCCACTATCTTCATAA | 79 | 2962 |
| 1463206 | N/A | N/A | 225359 | 225378 | TTTCCTACTGCCTTTCTCAT | 48 | 2963 |

TABLE 42-continued

Reduction of APP RNA by 5-10-5 MOE gapmers with mixed PO/PS internucleoside linkages in A431 cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1463218 | N/A | N/A | 234370 | 234389 | GTTCATTCCCCTAGCCTGCA | 47 | 2964 |
| 1463225 | N/A | N/A | 221005 | 221024 | CTCTGTTCTCAATTCATGGT | 13 | 2965 |
| 1463228 | N/A | N/A | 231288 | 231307 | CTGTGTCCTTATTTCTTCAA | 18 | 2966 |
| 1463264 | N/A | N/A | 225381 | 225400 | TTATGCCTTTGTTCCCTCTT | 27 | 2967 |
| 1463265 | N/A | N/A | 223617 | 223636 | GCAGCTTTTTTTTTTCTTT | 9 | 2968 |
| 1463267 | N/A | N/A | 231032 | 231051 | CTCCACAGTCCCTCATCCTC | 85 | 2969 |
| 1463278 | N/A | N/A | 221192 | 221211 | CTTCAGTTCATTAAGACTGA | 100 | 2970 |
| 1463285 | N/A | N/A | 222732 | 222751 | AGCATGACTCCATTCTTCCT | 20 | 2971 |
| 1463291 | N/A | N/A | 219075 | 219094 | CTTGTTCTCCTATTTCTGTT | 62 | 2972 |
| 1463293 | N/A | N/A | 220129 | 220148 | TCCTGGTTTTGATAATGGAC | 77 | 2973 |
| 1463305 | N/A | N/A | 222571 | 222590 | AACCATTGTATCTCTCTACA | 10 | 2974 |
| 1463311 | N/A | N/A | 235334 | 235353 | CTGTGCTTCACTTGGCCCCA | 55 | 2975 |
| 1463316 | N/A | N/A | 229326 | 229345 | ATCTCAATTTGGATTCATCT | 23 | 2976 |
| 1463324 | N/A | N/A | 221315 | 221334 | GCTTATTTCCCTATAGTTAT | 12 | 2977 |
| 1463336 | N/A | N/A | 225369 | 225388 | TCCCTCTTTATTTCCTACTG | 25 | 2978 |
| 1463337 | N/A | N/A | 234802 | 234821 | CTTTCATGTTCCCTTGAGGA | 22 | 2979 |
| 1463343 | N/A | N/A | 222742 | 222761 | CCTTCTTCTCAGCATGACTC | 22 | 2980 |
| 1463357 | N/A | N/A | 220563 | 220582 | GCCAGCTGTTCCCTTGAGCG | 55 | 2981 |
| 1463360 | N/A | N/A | 222720 | 222739 | TTCTTCCTCATTTTCACCCA | 29 | 2982 |
| 1463361 | N/A | N/A | 220896 | 220915 | AGTTGCTTTTTTTCTCTTCT | 7 | 2983 |
| 1463370 | N/A | N/A | 232980 | 232999 | CTGGGCATGGTATTTGCAAT | 30 | 2984 |
| 1463372 | N/A | N/A | 222752 | 222771 | CGATAGCATTCCTTCTTCTC | 39 | 2985 |
| 1463380 | N/A | N/A | 221341 | 221360 | CATCAACTTTTTAGTCCTTT | 5 | 2986 |
| 1463381 | N/A | N/A | 222428 | 222447 | GTATGCTATTTGTACTGAAC | 7 | 2987 |
| 1463384 | N/A | N/A | 222772 | 222791 | ATGTCAATTTTCCCCTTCAC | 14 | 2988 |
| 1463397 | N/A | N/A | 224442 | 224461 | GCCCACTTCATCAGTCCAAG | 26 | 2989 |
| 1463399 | N/A | N/A | 231620 | 231639 | GCATATTACATGGTTTTCCT | 9 | 2990 |
| 1463400 | N/A | N/A | 220457 | 220476 | TGTATCTATTTCCAACCCAA | 38 | 2991 |
| 1463402 | N/A | N/A | 219533 | 219552 | GTTCCAGCCTGACAGTTTCA | 52 | 2992 |
| 1463404 | N/A | N/A | 220056 | 220075 | CCTCTCTGTACTATTTTCC | 53 | 2993 |
| 1463405 | N/A | N/A | 220937 | 220956 | ACTGAGTTGCTCCTTCTGAA | 17 | 2994 |
| 1463408 | N/A | N/A | 229106 | 229125 | ACTGTGGTCTGACTTCACTT | 92 | 2995 |
| 1463415 | N/A | N/A | 225614 | 225633 | GCTGCATTTTCCTGAAGAG | 21 | 2996 |
| 1463420 | N/A | N/A | 233345 | 233364 | GCATCAATTCCTTTGGGTTT | 15 | 2997 |
| 1463427 | N/A | N/A | 218640 | 218659 | ACAACTTTGTTTTTCTCAT | 54 | 2998 |
| 1463428 | N/A | N/A | 220479 | 220498 | GCTCTGATTCCAGATGATAA | 24 | 2999 |

TABLE 42-continued

Reduction of APP RNA by 5-10-5 MOE gapmers with mixed PO/PS internucleoside linkages in A431 cells

| Compound Number | SEQ ID No: 1 Start Site | SEQ ID No: 1 Stop Site | SEQ ID No: 2 Start Site | SEQ ID No: 2 Stop Site | Sequence (5' to 3') | APP (% UTC) | SEQ ID NO |
|---|---|---|---|---|---|---|---|
| 1463444 | N/A | N/A | 229858 | 229877 | ACTCATGCTTTTAGGAGCAT | 45 | 3000 |
| 1463457 | N/A | N/A | 229340 | 229359 | ATATTTCAAAATTAATCTCA | 86 | 3001 |
|  | N/A | N/A | 229373 | 229392 |  |  |  |
| 1463464 | N/A | N/A | 220242 | 220261 | ATGTGGTATTTTATTCTCTT | 5 | 3002 |
| 1463470 | N/A | N/A | 234015 | 234034 | GCCACAGTAGAGTATAGTAT | 17 | 3003 |
| 1463476 | N/A | N/A | 221734 | 221753 | GTTCTTTATTTTTATTATAC | 16 | 3004 |
| 1463480 | N/A | N/A | 224123 | 224142 | GCAGGTCTTGGCTTCCACCC | 41 | 3005 |
| 1463487 | N/A | N/A | 234195 | 234214 | TGGTTAGTTTGCTTCAAGCA | 9 | 3006 |
| 1463496 | N/A | N/A | 228109 | 228128 | GGTCTTGCCATGTTTCCCAT | 28 | 3007 |
| 1463506 | N/A | N/A | 221087 | 221106 | CTGATGTCTATTCTCCAAGT | 19 | 3008 |
| 1463507 | N/A | N/A | 223722 | 223741 | AGCTCTTTTCTCCGTTCTCT | 6 | 3009 |
| 1463512 | N/A | N/A | 229284 | 229303 | CACTGATTTTTTTCCCCTCC | 15 | 3010 |
| 1463515 | N/A | N/A | 228944 | 228963 | GCCTCAGGCTCCATCCATTT | 86 | 3011 |
| 1463516 | N/A | N/A | 220394 | 220413 | ACATATTGCTTATATGTTGG | 13 | 3012 |
| 1463521 | N/A | N/A | 220049 | 220068 | GTACTATTTTCCAAGTTCT | 8 | 3013 |
| 1463522 | N/A | N/A | 222448 | 222467 | GCCAGTGTCTCTGAATTTTA | 11 | 3014 |
| 1463529 | N/A | N/A | 222760 | 222779 | CCCTTCACCGATAGCATTCC | 65 | 3015 |
| 1463541 | N/A | N/A | 231112 | 231131 | ATGCATCACGGCCATCCATC | 58 | 3016 |
| 1463554 | N/A | N/A | 233403 | 233422 | ATGCATGCATTTTTTTCTA | 61 | 3017 |
| 1463558 | N/A | N/A | 222726 | 222745 | ACTCCATTCTTCCTCATTTT | 46 | 3018 |
| 1463572 | N/A | N/A | 221300 | 221319 | GTTATTACCTATGCCACTTC | 23 | 3019 |
| 1463577 | N/A | N/A | 226498 | 226517 | ACCGTACTTTGCCATTCATT | 8 | 3020 |
| 1463579 | N/A | N/A | 222520 | 222539 | GCTTGTATTTATAAGCACAA | 58 | 3021 |
| 1463582 | N/A | N/A | 221636 | 221655 | CCCTAATATGTTCTTAATCC | 49 | 3022 |
| 1463601 | N/A | N/A | 219943 | 219962 | TGGCTTCCCTGCTCAGCCAT | 80 | 3023 |
| 1463605 | N/A | N/A | 220776 | 220795 | ACTGCACCTCCCTGACATAT | 39 | 3024 |
| 1463606 | N/A | N/A | 219188 | 219207 | GCCCAGGTTATTTTCTTAC | 59 | 3025 |
| 1463611 | N/A | N/A | 218738 | 218757 | TGGGCTTCATTTAGGCTCAC | 98 | 3026 |
| 1463621 | N/A | N/A | 233880 | 233899 | CTGCAATTTCTCTATAATCT | 14 | 3027 |
| 1463625 | N/A | N/A | 231902 | 231921 | GCTGATATTCATGTTCTCTT | 5 | 3028 |
| 1463626 | N/A | N/A | 224045 | 224064 | GTTCAATTTCTTCAACTGTA | 4 | 3029 |
| 1463627 | N/A | N/A | 234352 | 234371 | CACTGATTCCTCTTTTTCTC | 33 | 3030 |
| 1463631 | N/A | N/A | 222079 | 222098 | AGGACTATAGATGACAACTA | 35 | 3031 |

Example 4: Dose-Dependent Inhibition of Human APP in SH-SY5Y Cells by Modified Oligonucleotides Modified oligonucleotides selected from the examples above were tested at various doses in SH-SY5Y cells. The modified oligonucleotides were tested in a series of experiments using the same culture conditions. The results for each experiment are presented in separate tables shown below. Cells were plated at a density of 20,000 cells per well and were transfected using electroporation with modified oligonucleotides at various doses, as specified in the tables below. After a treatment period of approximately 24 hours, APP RNA levels were measured as previously described using the human APP primer-probe set RTS35572 (described herein above). APP RNA levels were normalized to total RNA, as measured by RIBOGREEN®. Results are presented as percent APP RNA, relative to untreated control cells (% UTC).

The half maximal inhibitory concentration ($IC_{50}$) of each modified oligonucleotide was calculated using a linear regression on a log/linear plot of the data in Excel and is also presented in the tables below. N.D in the table below refers to instances where the value was Not Defined. Compound IDs 912255, 912262, 912263, 912267, 912272, 912294, 912295, 912298, and 912301 were previously described in PCT/US20/15701.

TABLE 43

Dose-dependent reduction of human APP RNA in SH-SY5Y cells by modified oligonucleotides

| Compound No. | APP RNA (% UTC) | | | | $IC_{50}$ (µM) |
|---|---|---|---|---|---|
| | 78 nM | 312 nM | 1250 nM | 5000 nM | |
| 1353637 | 84 | 55 | 29 | 15 | 0.48 |
| 1353643 | 94 | 77 | 42 | 22 | 1.01 |
| 1353645 | 110 | 91 | 52 | 27 | 1.64 |
| 1353653 | 86 | 58 | 38 | 18 | 0.62 |
| 1353833 | 91 | 84 | 43 | 23 | 1.12 |
| 1353849 | 103 | 76 | 53 | 31 | 1.54 |
| 1353867 | 92 | 66 | 36 | 27 | 0.86 |
| 1353889 | 88 | 77 | 33 | 19 | 0.78 |
| 1353899 | 80 | 66 | 30 | 13 | 0.52 |
| 1353901 | 103 | 86 | 43 | 21 | 1.19 |
| 1353910 | 102 | 76 | 49 | 18 | 1.11 |
| 1353917 | 104 | 101 | 58 | 29 | 2.05 |
| 1353978 | 104 | 85 | 47 | 28 | 1.43 |
| 1353989 | 102 | 82 | 52 | 26 | 1.46 |
| 1354007 | 88 | 60 | 33 | 10 | 0.56 |
| 1354030 | 103 | 82 | 40 | 22 | 1.10 |
| 1354037 | 103 | 80 | 53 | 26 | 1.42 |
| 1354055 | 123 | 99 | 59 | 21 | 1.74 |
| 1354057 | 69 | 46 | 33 | 13 | 0.29 |

TABLE 44

Dose-dependent reduction of human APP RNA in SH-SY5Y cells by modified oligonucleotides

| Compound No. | APP RNA (% UTC) | | | | $IC_{50}$ (µM) |
|---|---|---|---|---|---|
| | 78 nM | 312 nM | 1250 nM | 5000 nM | |
| 1353647 | 111 | 83 | 51 | 15 | 1.19 |
| 1353731 | 93 | 28 | 43 | 11 | 0.43 |
| 1353733 | 88 | 68 | 35 | 15 | 0.67 |
| 1353736 | 92 | 73 | 44 | 19 | 0.92 |
| 1353750 | 80 | 48 | 64 | 29 | 1.07 |
| 1353830 | 106 | 95 | 87 | 41 | >5.0 |
| 1353875 | 107 | 82 | 51 | 20 | 1.27 |

TABLE 44-continued

Dose-dependent reduction of human APP RNA in SH-SY5Y cells by modified oligonucleotides

| Compound No. | APP RNA (% UTC) | | | | $IC_{50}$ (µM) |
|---|---|---|---|---|---|
| | 78 nM | 312 nM | 1250 nM | 5000 nM | |
| 1353889 | 97 | 82 | 42 | 21 | 1.06 |
| 1353913 | 83 | 55 | 41 | 21 | 0.63 |
| 1353959 | 94 | 100 | 72 | 47 | >5.0 |
| 1353992 | 108 | 73 | 43 | 25 | 1.16 |
| 1354021 | 110 | 88 | 60 | 35 | 2.23 |
| 1354048 | 109 | 103 | 55 | 34 | 2.21 |
| 1354049 | 85 | 74 | 57 | 24 | 1.25 |
| 1354052 | 126 | 116 | 80 | 66 | >5.0 |
| 1354060 | 123 | 111 | 65 | 32 | 2.60 |
| 1354063 | 97 | 110 | 97 | 62 | >5.0 |
| 1354072 | 84 | 64 | 37 | 20 | 0.68 |
| 1354081 | 98 | 68 | 55 | 35 | 1.60 |

TABLE 45

Dose-dependent reduction of human APP RNA in SH-SY5Y cells by modified oligonucleotides

| Compound No. | APP RNA (% UTC) | | | | $IC_{50}$ (µM) |
|---|---|---|---|---|---|
| | 78 nM | 312 nM | 1250 nM | 5000 nM | |
| 1353655 | 98 | 89 | 52 | 40 | 2.30 |
| 1353664 | 129 | 109 | 80 | 43 | 4.45 |
| 1353671 | 84 | 78 | 48 | 23 | 1.08 |
| 1353686 | 104 | 85 | 54 | 22 | 1.42 |
| 1353710 | 111 | 83 | 39 | 17 | 1.06 |
| 1353723 | 138 | 120 | 97 | 64 | >5.0 |
| 1353749 | 118 | 95 | 69 | 52 | >5.0 |
| 1353753 | 115 | 105 | 72 | 40 | 3.69 |
| 1353762 | 117 | 96 | 62 | 42 | 2.95 |
| 1353792 | 120 | 67 | 38 | 25 | 1.08 |
| 1353815 | 81 | 68 | 40 | 16 | 0.67 |
| 1353839 | 117 | 98 | 63 | 34 | 2.47 |
| 1353884 | 110 | 80 | 60 | 35 | 2.08 |
| 1353889 | 100 | 84 | 47 | 19 | 1.16 |
| 1353911 | 131 | 106 | 66 | 33 | 2.57 |
| 1353931 | 132 | 119 | 86 | 47 | >5.0 |
| 1353976 | 129 | 122 | 114 | 59 | >5.0 |
| 1354031 | 93 | 69 | 41 | 24 | 0.93 |
| 1354067 | 97 | 84 | 58 | 26 | 1.61 |

TABLE 46

Dose-dependent reduction of human APP RNA in SH-SY5Y cells by modified oligonucleotides

| Compound No. | APP RNA (% UTC) | | | | $IC_{50}$ (µM) |
|---|---|---|---|---|---|
| | 78 nM | 312 nM | 1250 nM | 5000 nM | |
| 1332169 | 105 | 104 | 105 | 73 | >5.0 |
| 1332194 | 90 | 90 | 85 | 49 | >5.0 |
| 1332202 | 117 | 98 | 48 | 30 | 1.74 |
| 1332204 | 64 | 29 | 18 | 10 | 0.13 |
| 1332206 | 114 | 108 | 110 | 91 | >5.0 |
| 1332209 | 69 | 68 | 25 | 23 | 0.47 |
| 1332210 | 70 | 58 | 38 | 23 | 0.49 |
| 1332211 | 81 | 48 | 8 | 5 | 0.29 |
| 1332212 | 115 | 92 | 60 | 41 | 2.75 |
| 1332213 | 74 | 77 | 48 | 24 | 0.98 |
| 1333917 | 55 | 38 | 9 | 11 | 0.10 |
| 1333926 | 60 | 38 | 24 | 18 | 0.14 |
| 1333929 | 74 | 62 | 34 | 12 | 0.47 |
| 1335707 | 85 | 71 | 30 | 20 | 0.68 |
| 1335708 | 64 | 35 | 19 | 11 | 0.16 |
| 1335709 | 86 | 75 | 52 | 43 | 2.22 |
| 1335712 | 72 | 40 | 14 | 7 | 0.22 |

TABLE 46-continued

Dose-dependent reduction of human APP RNA in SH-SY5Y cells by modified oligonucleotides

| Compound No. | APP RNA (% UTC) | | | | IC$_{50}$ (μM) |
|---|---|---|---|---|---|
| | 78 nM | 312 nM | 1250 nM | 5000 nM | |
| 1335717 | 76 | 29 | 12 | 15 | 0.19 |
| 1354057 | 93 | 62 | 34 | 9 | 0.62 |

TABLE 47

Dose-dependent reduction of human APP RNA in SH-SY5Y cells by modified oligonucleotides

| Compound No. | APP RNA (% UTC) | | | | IC$_{50}$ (μM) |
|---|---|---|---|---|---|
| | 78 nM | 312 nM | 1250 nM | 5000 nM | |
| 912255 | 104 | 99 | 68 | 39 | 3.44 |
| 912262† | 30 | 22 | 9 | 5 | <0.1 |
| 912263† | 29 | 20 | 9 | 5 | <0.1 |
| 912267† | 58 | 32 | 11 | 7 | 0.10 |
| 912272† | 25 | 10 | 4 | 3 | <0.1 |
| 912294 | 120 | 96 | 67 | 36 | 2.73 |
| 912295† | 36 | 20 | 11 | 5 | <0.1 |
| 912298 | 86 | 73 | 42 | 20 | 0.87 |
| 912301 | 110 | 82 | 32 | 19 | 0.98 |
| 1332183 | 85 | 57 | 30 | 17 | 0.54 |
| 1332200 | 89 | 97 | 108 | 56 | >5.0 |
| 1332207 | 119 | 91 | 63 | 20 | 1.66 |
| 1333927 | 84 | 50 | 25 | 11 | 0.41 |
| 1333935 | 66 | 38 | 18 | 13 | 0.17 |
| 1335702 | 62 | 36 | 24 | 7 | 0.15 |
| 1354057 | 85 | 40 | 19 | 15 | 0.34 |

TABLE 48

Dose-dependent reduction of human APP RNA in SH-SY5Y cells by modified oligonucleotides

| Compound No. | APP RNA (% UTC) | | | | IC$_{50}$ (μM) |
|---|---|---|---|---|---|
| | 125 nM | 500 nM | 2000 nM | 8000 nM | |
| 1354057 | 91 | 42 | 15 | 10 | 0.58 |
| 1397573 | 79 | 73 | 40 | 21 | 1.24 |
| 1397586 | 91 | 82 | 64 | 36 | 3.90 |
| 1397705 | 106 | 87 | 80 | 32 | 4.88 |
| 1397786 | 111 | 76 | 46 | 17 | 1.75 |
| 1398012 | 97 | 52 | 48 | 17 | 1.21 |
| 1398133 | 99 | 82 | 63 | 34 | 3.56 |
| 1398494 | 100 | 87 | 65 | 18 | 2.48 |
| 1398569 | 96 | 95 | 61 | 48 | 6.95 |
| 1398653 | 96 | 68 | 48 | 16 | 1.46 |
| 1398916 | 105 | 79 | 63 | 26 | 2.70 |
| 1399000 | 109 | 99 | 86 | 64 | >8.0 |
| 1399084 | 95 | 92 | 66 | 23 | 3.02 |
| 1399137 | 110 | 104 | 106 | 97 | >8.0 |
| 1399215 | 109 | 79 | 63 | 33 | 3.32 |
| 1399216 | 90 | 80 | 57 | 13 | 1.72 |
| 1399291 | 99 | 89 | 65 | 53 | >8.0 |
| 1399365 | 91 | 59 | 36 | 26 | 1.21 |
| 1399507 | 111 | 90 | 86 | 52 | >8.0 |

TABLE 49

Dose-dependent reduction of human APP RNA in SH-SY5Y cells by modified oligonucleotides

| Compound No. | APP RNA (% UTC) | | | | IC$_{50}$ (μM) |
|---|---|---|---|---|---|
| | 125 nM | 500 nM | 2000 nM | 8000 nM | |
| 1354057 | 88 | 40 | 21 | 7 | 0.55 |
| 1397616 | 98 | 96 | 88 | 62 | >8.0 |
| 1397821 | 86 | 62 | 27 | 14 | 0.85 |
| 1397824 | 75 | 36 | 14 | 7 | 0.35 |
| 1397860 | 84 | 62 | 39 | 19 | 1.06 |
| 1397882 | 91 | 90 | 63 | 29 | 3.27 |
| 1397883 | 78 | 49 | 24 | 13 | 0.56 |
| 1397940 | 97 | 90 | 64 | 27 | 3.12 |
| 1398227 | 95 | 70 | 36 | 13 | 1.20 |
| 1398440 | 97 | 42 | 46 | 11 | 0.94 |
| 1398681 | 75 | 62 | 24 | 13 | 0.67 |
| 1398748 | 107 | 106 | 75 | 30 | 4.80 |
| 1398829 | 65 | 37 | 24 | 11 | 0.28 |
| 1398830 | 112 | 101 | 78 | 44 | 7.84 |
| 1398922 | 95 | 78 | 42 | 27 | 1.84 |
| 1399070 | 97 | 67 | 41 | 11 | 1.22 |
| 1399404 | 104 | 83 | 37 | 10 | 1.42 |
| 1399427 | 82 | 44 | 15 | 7 | 0.49 |
| 1399430 | 95 | 88 | 58 | 37 | 3.84 |

TABLE 50

Dose-dependent reduction of human APP RNA in SH-SY5Y cells by modified oligonucleotides

| Compound No. | APP RNA (% UTC) | | | | IC$_{50}$ (μM) |
|---|---|---|---|---|---|
| | 125 nM | 500 nM | 2000 nM | 8000 nM | |
| 1354057 | 88 | 68 | 18 | 9 | 0.81 |
| 1397541 | 118 | 96 | 72 | 39 | 5.31 |
| 1397700 | 95 | 69 | 43 | 18 | 1.40 |
| 1397706 | 93 | 76 | 45 | 27 | 1.82 |
| 1397713 | 112 | 88 | 71 | 48 | 7.23 |
| 1398034 | 93 | 61 | 36 | 14 | 1.06 |
| 1398203 | 107 | 63 | 30 | 14 | 1.16 |
| 1398406 | 85 | 72 | 50 | 22 | 1.62 |
| 1398534 | 117 | 86 | 47 | 32 | 2.64 |
| 1398539 | 82 | 50 | 23 | 13 | 0.62 |
| 1398644 | 90 | 73 | 31 | 14 | 1.12 |
| 1398760 | 105 | 98 | 80 | 50 | >8.0 |
| 1399010 | 99 | 93 | 56 | 24 | 2.64 |
| 1399026 | 95 | 75 | 57 | 49 | 5.46 |
| 1399147 | 86 | 59 | 31 | 12 | 0.85 |
| 1399261 | 103 | 83 | 65 | 27 | 3.03 |
| 1399295 | 90 | 65 | 53 | 14 | 1.37 |
| 1399442 | 106 | 97 | 48 | 28 | 2.64 |
| 1399511 | 68 | 42 | 22 | 14 | 0.35 |

TABLE 51

Dose-dependent reduction of human APP RNA in SH-SY5Y cells by modified oligonucleotides

| Compound No. | APP RNA (% UTC) | | | | IC$_{50}$ (μM) |
|---|---|---|---|---|---|
| | 125 nM | 500 nM | 2000 nM | 8000 nM | |
| 1354057 | 85 | 44 | 21 | 21 | 0.63 |
| 1397534 | 117 | 98 | 62 | 23 | 2.98 |
| 1397572 | 71 | 37 | 21 | 10 | 0.35 |
| 1397580 | 98 | 73 | 32 | 22 | 1.39 |
| 1397620 | 96 | 68 | 32 | 13 | 1.12 |
| 1397948 | 92 | 58 | 34 | 14 | 0.96 |
| 1398033 | 91 | 99 | 60 | 20 | 2.62 |
| 1398060 | 111 | 85 | 41 | 19 | 1.82 |
| 1398125 | 114 | 95 | 42 | 25 | 2.29 |
| 1398128 | 103 | 83 | 39 | 16 | 1.60 |

TABLE 51-continued

Dose-dependent reduction of human APP RNA in SH-SY5Y cells by modified oligonucleotides

| Compound No. | APP RNA (% UTC) | | | | IC$_{50}$ ($\mu$M) |
|---|---|---|---|---|---|
| | 125 nM | 500 nM | 2000 nM | 8000 nM | |
| 1398213 | 87 | 61 | 36 | 15 | 0.98 |
| 1398429 | 58 | 25 | 14 | 29 | <0.1 |
| 1398541 | 94 | 72 | 38 | 11 | 1.20 |
| 1398772 | 87 | 67 | 31 | 16 | 1.02 |
| 1398935 | 93 | 84 | 41 | 18 | 1.59 |
| 1399141 | 99 | 78 | 68 | 52 | >8.0 |
| 1399380 | 111 | 77 | 47 | 19 | 1.84 |
| 1399436 | 71 | 45 | 29 | 19 | 0.49 |
| 1399500 | 104 | 63 | 35 | 23 | 1.37 |

TABLE 52

Dose-dependent reduction of human APP RNA in SH-SY5Y cells by modified oligonucleotides

| Compound No. | APP RNA (% UTC) | | | | IC$_{50}$ ($\mu$M) |
|---|---|---|---|---|---|
| | 125 nM | 500 nM | 2000 nM | 8000 nM | |
| 1354057 | 69 | 39 | 18 | 9 | 0.33 |
| 1397576 | 88 | 68 | 67 | 86 | >8.0 |
| 1397631 | 97 | 68 | 31 | 11 | 1.08 |
| 1397656 | 112 | 93 | 89 | 46 | >8.0 |
| 1397765 | 82 | 64 | 34 | 8 | 0.84 |
| 1397842 | 71 | 46 | 12 | 6 | 0.37 |
| 1397884 | 114 | 82 | 58 | 26 | 2.62 |
| 1398342 | 109 | 109 | 63 | 40 | 5.28 |
| 1398371 | 84 | 61 | 29 | 24 | 0.97 |
| 1398456 | 109 | 63 | 54 | 15 | 1.65 |
| 1398752 | 73 | 62 | 35 | 12 | 0.76 |
| 1398762 | 107 | 95 | 52 | 19 | 2.29 |
| 1398948 | 90 | 56 | 43 | 18 | 1.12 |
| 1398955 | 108 | 83 | 43 | 19 | 1.81 |
| 1399033 | 90 | 74 | 44 | 24 | 1.61 |
| 1399164 | 112 | 80 | 42 | 20 | 1.83 |
| 1399176 | 80 | 53 | 24 | 11 | 0.62 |
| 1399204 | 108 | 88 | 59 | 18 | 2.30 |
| 1399473 | 100 | 90 | 91 | 68 | >8.0 |

TABLE 53

Dose-dependent reduction of human APP RNA in SH-SY5Y cells by modified oligonucleotides

| Compound No. | APP RNA (% UTC) | | | | IC$_{50}$ ($\mu$M) |
|---|---|---|---|---|---|
| | 125 nM | 500 nM | 2000 nM | 8000 nM | |
| 1354057 | 65 | 31 | 18 | 6 | 0.23 |
| 1397604 | 101 | 76 | 52 | 25 | 2.10 |
| 1397614 | 94 | 71 | 37 | 22 | 1.40 |
| 1397772 | 93 | 88 | 52 | 28 | 2.44 |
| 1397795 | 80 | 55 | 34 | 14 | 0.76 |
| 1397925 | 96 | 80 | 61 | 22 | 2.33 |
| 1398169 | 95 | 64 | 32 | 27 | 1.30 |
| 1398187 | 96 | 86 | 53 | 30 | 2.67 |
| 1398341 | 112 | 114 | 172 | 92 | >8.0 |
| 1398518 | 86 | 56 | 29 | 14 | 0.81 |
| 1398537 | 103 | 76 | 50 | 32 | 2.43 |
| 1398550 | 86 | 53 | 24 | 13 | 0.71 |
| 1398668 | 94 | 94 | 70 | 46 | >8.0 |
| 1398686 | 103 | 89 | 95 | 53 | >8.0 |
| 1398806 | 25 | 23 | 12 | 5 | <0.1 |
| 1399025 | 141 | 121 | 101 | 58 | >8.0 |
| 1399198 | 111 | 130 | 98 | 35 | >8.0 |
| 1399200 | 110 | 75 | 37 | 18 | 1.56 |

Example 5: Dose-Dependent Inhibition of Human APP in A431 Cells by Modified Oligonucleotides Certain modified oligonucleotides described in the studies above exhibiting significant in vitro inhibition of APP RNA were selected and tested at various doses in A431 cells. The modified oligonucleotides were tested in a series of experiments using the same culture conditions. The results for each experiment are presented in separate tables shown below. Cells plated at a density of 10,000 cells per well were treated with modified oligonucleotides at various doses by free uptake, as specified in the tables below. After a treatment period of approximately 48 hours, APP RNA levels were measured as previously described using the Human APP primer-probe set RTS35432 (described herein above). APP RNA levels were normalized to total RNA, as measured by RIBOGREEN®. Results are presented as percent APP RNA, relative to untreated control cells (% UTC). The half maximal inhibitory concentration (IC$_{50}$) of each modified oligonucleotide was calculated using a linear regression on a log/linear plot of the data in Excel and is also presented in the tables below. N.D in the table below refers to instances where the value was Not Defined.

TABLE 54

Dose-dependent reduction of human APP RNA in A431 cells by modified oligonucleotides

| Compound No. | APP RNA (% UTC) | | | | IC$_{50}$ ($\mu$M) |
|---|---|---|---|---|---|
| | 31.25 nM | 125.0 nM | 500.0 nM | 2000.0 nM | |
| 1397572 | 75 | 33 | 18 | 11 | 0.09 |
| 1399147 | 77 | 53 | 35 | 20 | 0.19 |
| 1463194 | 67 | 49 | 26 | 18 | 0.11 |
| 1463220 | 62 | 34 | 18 | 11 | 0.05 |
| 1463237 | 74 | 55 | 22 | 19 | 0.15 |
| 1463238 | 95 | 49 | 24 | 14 | 0.2 |
| 1463288 | 95 | 59 | 28 | 24 | 0.27 |
| 1463289 | 71 | 38 | 22 | 11 | 0.09 |
| 1463294 | 68 | 39 | 16 | 14 | 0.08 |
| 1463340 | 70 | 35 | 21 | 14 | 0.08 |
| 1463409 | 72 | 46 | 30 | 18 | 0.13 |
| 1463460 | 81 | 32 | 20 | 14 | 0.1 |
| 1463466 | 55 | 23 | 13 | 11 | 0.02 |
| 1463511 | 96 | 62 | 37 | 20 | 0.31 |
| 1463567 | 69 | 50 | 31 | 20 | 0.14 |
| 1463578 | 66 | 35 | 17 | 9 | 0.07 |
| 1463580 | 79 | 42 | 25 | 13 | 0.13 |
| 1463589 | 87 | 51 | 25 | 18 | 0.19 |
| 1463595 | 58 | 38 | 17 | 11 | 0.05 |

TABLE 55

Dose-dependent reduction of human APP RNA in A431 cells by modified oligonucleotides

| Compound No. | APP RNA (% UTC) | | | | IC$_{50}$ ($\mu$M) |
|---|---|---|---|---|---|
| | 31.25 nM | 125.0 nM | 500.0 nM | 2000.0 nM | |
| 1397572 | 70 | 34 | 17 | 11 | 0.07 |
| 1463172 | 41 | 17 | 10 | 8 | 0.00 |
| 1463185 | 67 | 37 | 13 | 12 | 0.07 |
| 1463213 | 65 | 37 | 23 | 17 | 0.07 |
| 1463266 | 71 | 57 | 26 | 20 | 0.15 |
| 1463354 | 126 | 76 | 42 | 27 | 0.53 |
| 1463379 | 78 | 38 | 25 | 17 | 0.12 |
| 1463388 | 50 | 24 | 12 | 9 | 0.02 |
| 1463391 | 138 | 90 | 50 | 30 | 0.69 |
| 1463394 | 50 | 20 | 11 | 7 | 0.02 |
| 1463451 | 53 | 42 | 22 | 13 | 0.04 |
| 1463455 | 73 | 50 | 27 | 17 | 0.14 |

TABLE 55-continued

Dose-dependent reduction of human APP RNA in A431 cells by modified oligonucleotides

| Compound No. | APP RNA (% UTC) | | | | IC$_{50}$ (μM) |
|---|---|---|---|---|---|
| | 31.25 nM | 125.0 nM | 500.0 nM | 2000.0 nM | |
| 1463462 | 122 | 72 | 44 | 31 | 0.55 |
| 1463497 | 72 | 31 | 18 | 9 | 0.08 |
| 1463508 | 58 | 34 | 15 | 17 | 0.04 |
| 1463509 | 92 | 72 | 44 | 31 | 0.47 |
| 1463525 | 121 | 76 | 37 | 28 | 0.49 |
| 1463542 | 58 | 30 | 16 | 12 | 0.04 |
| 1463575 | 75 | 59 | 35 | 25 | 0.22 |

TABLE 56

Dose-dependent reduction of human APP RNA in A431 cells by modified oligonucleotides

| Compound No. | APP RNA (% UTC) | | | | IC$_{50}$ (μM) |
|---|---|---|---|---|---|
| | 31.25 nM | 125.0 nM | 500.0 nM | 2000.0 nM | |
| 1397572 | 68 | 34 | 21 | 11 | 0.07 |
| 1397795 | 53 | 28 | 19 | 12 | 0.02 |
| 1463192 | 75 | 46 | 24 | 17 | 0.13 |
| 1463199 | 65 | 36 | 18 | 10 | 0.07 |
| 1463203 | 48 | 20 | 13 | 9 | 0.01 |
| 1463227 | 70 | 39 | 20 | 15 | 0.09 |
| 1463236 | 71 | 40 | 23 | 14 | 0.10 |
| 1463313 | 73 | 55 | 35 | 24 | 0.20 |
| 1463368 | 75 | 50 | 31 | 20 | 0.16 |
| 1463387 | 79 | 44 | 24 | 16 | 0.13 |
| 1463425 | 91 | 60 | 34 | 23 | 0.28 |
| 1463450 | 82 | 57 | 34 | 22 | 0.23 |
| 1463472 | 89 | 45 | 28 | 16 | 0.18 |
| 1463478 | 58 | 30 | 19 | 12 | 0.04 |
| 1463485 | 96 | 65 | 35 | 22 | 0.32 |
| 1463498 | 44 | 23 | 15 | 10 | 0.01 |
| 1463514 | 57 | 27 | 14 | 11 | 0.03 |
| 1463553 | 60 | 29 | 17 | 11 | 0.04 |
| 1463612 | 84 | 53 | 29 | 18 | 0.20 |

TABLE 57

Dose-dependent reduction of human APP RNA in A431 cells by modified oligonucleotides

| Compound No. | APP RNA (% UTC) | | | | IC$_{50}$ (μM) |
|---|---|---|---|---|---|
| | 31.25 nM | 125.0 nM | 500.0 nM | 2000.0 nM | |
| 1397572 | 66 | 27 | 15 | 11 | 0.05 |
| 1463248 | 98 | 68 | 42 | 25 | 0.39 |

TABLE 57-continued

Dose-dependent reduction of human APP RNA in A431 cells by modified oligonucleotides

| Compound No. | APP RNA (% UTC) | | | | IC$_{50}$ (μM) |
|---|---|---|---|---|---|
| | 31.25 nM | 125.0 nM | 500.0 nM | 2000.0 nM | |
| 1463265 | 73 | 39 | 25 | 18 | 0.10 |
| 1463307 | 79 | 54 | 32 | 22 | 0.20 |
| 1463361 | 49 | 28 | 17 | 11 | 0.02 |
| 1463366 | 87 | 61 | 39 | 23 | 0.29 |
| 1463369 | 82 | 55 | 34 | 22 | 0.22 |
| 1463380 | 65 | 32 | 18 | 12 | 0.06 |
| 1463381 | 86 | 49 | 34 | 18 | 0.20 |
| 1463399 | 87 | 55 | 32 | 19 | 0.22 |
| 1463442 | 72 | 42 | 24 | 15 | 0.11 |
| 1463464 | 54 | 25 | 13 | 10 | 0.02 |
| 1463482 | 90 | 38 | 48 | 30 | 0.28 |
| 1463487 | 80 | 44 | 28 | 15 | 0.15 |
| 1463507 | 55 | 27 | 16 | 11 | 0.03 |
| 1463521 | 76 | 42 | 26 | 18 | 0.13 |
| 1463577 | 71 | 41 | 23 | 18 | 0.10 |
| 1463625 | 39 | 19 | 10 | 8 | 0.00 |
| 1463626 | 56 | 29 | 14 | 10 | 0.03 |

Example 6: Design of MOE Gapmer Modified Oligonucleotides with Mixed PO/PS Internucleoside Linkages Complementary to a Human APP Nucleic Acid Modified oligonucleotides complementary to human APP nucleic acid were designed and synthesized. "Start site" in all the tables below indicates the 5'-most nucleoside of the target sequence to which the modified oligonucleotide is complementary. "Stop site" in all the tables below indicates the 3'-most nucleoside of the target sequence to which the modified oligonucleotide is complementary. As shown in the tables below, the modified oligonucleotides are complementary to either SEQ ID NO: 1 (described hereinabove), and/or to SEQ ID NO: 2 (described hereinabove). 'N/A' indicates that the modified oligonucleotide is not complementary to that particular target sequence with 100% complementarity.

The modified oligonucleotides in the table below are 5-10-5 MOE gapmers. The sugar motif of the gapmers is (from 5' to 3'): eeeeedddddddddddeeeee; wherein 'd' represents a 2'-β-D-deoxyribosyl sugar moiety, and 'e' represents a 2'-MOE sugar moiety. The internucleoside motif of the gapmers is (from 5' to 3'): sooosssssssssssooss, wherein each "s" represents a phosphorothioate internucleoside linkage, and each 'o' represents a phosphodiester internucleoside linkage. Each cytosine nucleoside is a 5-methylcytosine.

TABLE 58

5-10-5 MOE gapmers with mixed PO/PS internucleoside linkages complementary to human APP

| Compound No. | Sequence (5' to 3') | SEQ ID No: 1 Start Site | SEQ ID No: 1 Stop Site | SEQ ID No: 2 Start Site | SEQ ID No: 2 Site Stop | SEQ ID No. |
|---|---|---|---|---|---|---|
| 1478917 | ATCCCACTTCCCATTCTGGA | 174 | 193 | 61937 | 61956 | 3032 |
| 1478919 | GGCATCACTTACAAACTCAC | 393 | 412 | 120656 | 120675 | 3033 |
| 1478925 | GAAGCTTACATCATTTTCTT | N/A | N/A | 25103 | 25122 | 3038 |
| 1478926 | AAGCTTACATCATTTTCTTG | N/A | N/A | 25102 | 25121 | 3039 |

TABLE 58-continued 5-10-5 MOE gapmers with mixed PO/PS internucleoside linkages complementary to human APP

| Compound No. | Sequence (5' to 3') | SEQ ID No: 1 Start Site | SEQ ID No: 1 Stop Site | SEQ ID No: 2 Start Site | SEQ ID No: 2 Site Stop | SEQ ID No. |
|---|---|---|---|---|---|---|
| 1498072 | TCTTGATATTTGTCAACCCA | 2002 | 2021 | 276332 | 276351 | 3034 |
| 1498073 | CTTGATATTTGTCAACCCAG | 2001 | 2020 | 276331 | 276350 | 3035 |

The modified oligonucleotides in the table below are 6-10-4 MOE gapmers. The gapmers are 20 nucleosides in length. The sugar motif of the gapmers is (from 5' to 3'): eeeeeedddddddddddeeee; wherein 'd' represents a 2'-β-D-deoxyribosyl sugar moiety, and 'e' represents a 2'-β-D-MOE sugar moiety. The internucleoside motif of the gapmers is (from 5' to 3'): sooooosssssssssssoss, wherein each "s" represents a phosphorothioate internucleoside linkage, and each 'o' represents a phosphodiester internucleoside linkage. Each cytosine nucleoside is a 5-methylcytosine.

TABLE 59

6-10-4 MOE gapmers with mixed PO/PS internucleoside linkages complementary to human APP

| Compound No. | Sequence (5' to 3') | SEQ ID No: 1 Start Site | SEQ ID No: 1 Stop Site | SEQ ID No: 2 Start Site | SEQ ID No: 2 Site Stop | SEQ ID No. |
|---|---|---|---|---|---|---|
| 1478902 | CATCACTTACAAACTCACCA | 391 | 410 | 120654 | 120673 | 2531 |
| 1478903 | CCCACTTCCCATTCTGGACA | 172 | 191 | 61935 | 61954 | 2529 |
| 1478904 | GATCTGAATCCCACTTCCCA | 181 | 200 | 61944 | 61963 | 2528 |
| 1478905 | TCCAAAGATTCCACTTTCTC | 1343 | 1362 | 198782 | 198801 | 2511 |
| 1478906 | GCTTACATCATTTTCTTGCA | N/A | N/A | 25100 | 25119 | 111 |
| 1478907 | CTTCCCATTCTCTCATGACC | 1258 | 1277 | 197972 | 197991 | 2523 |
| 1498058 | GTCTTGATATTTGTCAACCC | 2003 | 2022 | 276333 | 276352 | 3036 |
| 1498059 | TCTTGATATTTGTCAACCCA | 2002 | 2021 | 276332 | 276351 | 3034 |
| 1498060 | CTTGATATTTGTCAACCCAG | 2001 | 2020 | 276331 | 276350 | 3035 |
| 1498061 | TTGATATTTGTCAACCCAGA | 2000 | 2019 | 276330 | 276349 | 428 |
| 1498062 | TGATATTTGTCAACCCAGAA | 1999 | 2018 | 276329 | 276348 | 3037 |
| 1498065 | TCTCGAGATACTTGTCAACG | 1156 | 1175 | 191555 | 191574 | 1414 |
| 1498066 | CTCGAGATACTTGTCAACGG | 1155 | 1174 | 191554 | 191573 | 1289 |
| 1498067 | TCGAGATACTTGTCAACGGC | 1154 | 1173 | 191553 | 191572 | 1248 |
| 1498068 | CGAGATACTTGTCAACGGCA | 1153 | 1172 | 191552 | 191571 | 1129 |
| 1498069 | GAGATACTTGTCAACGGCAT | 1152 | 1171 | 191551 | 191570 | 1037 |
| 1498070 | AGATACTTGTCAACGGCATC | 1151 | 1170 | 191550 | 191569 | 960 |
| 1498071 | GATACTTGTCAACGGCATCA | 1150 | 1169 | 191549 | 191568 | 892 |

The modified oligonucleotides in the table below are 6-10-4 MOE gapmers. The gapmers are 20 nucleosides in length. The sugar motif of the gapmers is (from 5' to 3'): eeeeeedddddddddddeeee; wherein 'd' represents a 2'-β-D-deoxyribosyl sugar moiety, and 'e' represents a 2'-MOE sugar moiety. The internucleoside motif of the gapmers is (from 5' to 3'): soooosssssssssssoss, wherein each "s" represents a phosphorothioate internucleoside linkage, and each 'o' represents a phosphodiester internucleoside linkage. Each cytosine nucleoside is a 5-methylcytosine.

TABLE 60

6-10-4 MOE gapmers with mixed PO/PS internucleoside linkages complementary to human APP

| Compound No. | Sequence (5' to 3') | SEQ ID No: 1 Start Site | SEQ ID No: 1 Stop Site | SEQ ID No: 2 Start Site | SEQ ID No: 2 Site Stop | SEQ ID No. |
|---|---|---|---|---|---|---|
| 1498105 | CTTGATATTTGTCAACCCAG | 2001 | 2020 | 276331 | 276350 | 3035 |
| 1498106 | GAGATACTTGTCAACGGCAT | 1152 | 1171 | 191551 | 191570 | 1037 |

The modified oligonucleotides in the table below are 5-10-5 MOE gapmers. The gapmers are 20 nucleosides in length. The sugar motif of the gapmers is (from 5' to 3'): eeeeedddddddddddeeeee; wherein 'd' represents a 2'-β-D-deoxyribosyl sugar moiety, and 'e' represents a 2'-MOE sugar moiety. The internucleoside motif of the gapmers is (from 5' to 3'): ssoosssssssssssooss, wherein each "s" represents a phosphorothioate internucleoside linkage, and each 'o' represents a phosphodiester internucleoside linkage. Each cytosine nucleoside is a 5-methylcytosine.

TABLE 61

5-10-5 MOE gapmers with mixed PO/PS internucleoside linkages complementary to human APP

| Compound No. | Sequence (5' to 3') | SEQ ID No: 1 Start Site | SEQ ID No: 1 Stop Site | SEQ ID No: 2 Start Site | SEQ ID No: 2 Site Stop | SEQ ID No. |
|---|---|---|---|---|---|---|
| 1478908 | CATCACTTACAAACTCACCA | 391 | 410 | 120654 | 120673 | 2531 |
| 1478909 | CCCACTTCCCATTCTGGACA | 172 | 191 | 61935 | 61954 | 2529 |
| 1478910 | GATCTGAATCCCACTTCCCA | 181 | 200 | 61944 | 61963 | 2528 |
| 1478911 | TCCAAAGATTCCACTTTCTC | 1343 | 1362 | 198782 | 198801 | 2511 |
| 1478912 | GCTTACATCATTTTCTTGCA | N/A | N/A | 25100 | 25119 | 111 |
| 1478913 | CTTCCCATTCTCTCATGACC | 1258 | 1277 | 197972 | 197991 | 2523 |

Example 7: Tolerability of Modified Oligonucleotides Comprising 2'-MOE Nucleosides Complementary to Human APP in Wild-Type Mice, 3 Hour Study Modified oligonucleotides described above were tested in wild-type female C57/Bl6 mice to assess the tolerability of the oligonucleotides. Wild-type female C57/Bl6 mice each received a single ICV dose of modified oligonucleotide at 700 µg. Each treatment group consisted of 2-4 mice. A group of 2-4 mice received PBS as a negative control for each experiment. Each experiment is identified in separate tables below. At 3 hours post-injection, mice were evaluated according to seven different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching; (7) regular breathing. For each of the 7 criteria, a mouse was given a subscore of 0 if it met the criteria and 1 if it did not (the functional observational battery score or FOB). After all 7 criteria were evaluated, the scores were summed for each mouse and averaged within each treatment group. The results are presented in the tables below.

TABLE 62

Tolerability scores in mice

| Compound No. | 3 hr. FOB |
|---|---|
| PBS | 0.00 |
| 1332165 | 2.00 |
| 1332166 | 0.00 |
| 1332167 | 0.00 |
| 1332168 | 1.00 |
| 1332170 | 1.00 |
| 1332171 | 2.50 |
| 1332172 | 2.00 |
| 1332173 | 1.00 |
| 1332174 | 4.00 |
| 1332176 | 0.00 |
| 1332177 | 0.50 |
| 1332178 | 0.50 |
| 1332179 | 3.00 |
| 1332180 | 5.50 |
| 1332182 | 1.00 |
| 1332183 | 2.00 |
| 1332184 | 0.00 |
| 1332185 | 0.00 |
| 1332186 | 0.50 |
| 1332187 | 0.00 |
| 1332188 | 7.00 |

TABLE 62-continued

Tolerability scores in mice

| Compound No. | 3 hr. FOB |
|---|---|
| 1332189 | 0.00 |
| 1332190 | 1.00 |
| 1332192 | 1.00 |
| 1332193 | 3.50 |
| 1332194 | 0.50 |
| 1332195 | 0.50 |
| 1332196 | 1.00 |
| 1332197 | 1.00 |
| 1332198 | 1.00 |
| 1332199 | 1.00 |
| 1332200 | 0.50 |
| 1332201 | 0.50 |
| 1332202 | 1.50 |
| 1332203 | 1.00 |
| 1332204 | 0.50 |
| 1332205 | 0.50 |
| 1332206 | 3.00 |
| 1332207 | 1.00 |
| 1332208 | 1.00 |
| 1332209 | 0.00 |
| 1332210 | 1.00 |
| 1332211 | 1.00 |
| 1332212 | 1.00 |
| 1332213 | 1.00 |

TABLE 63

Tolerability scores in mice

| Compound No. | 3 hr. FOB |
|---|---|
| PBS | 0.00 |
| 1332169 | 0.00 |
| 1332181 | 4.00 |
| 1353640 | 2.00 |
| 1353707 | 2.50 |
| 1353716 | 0.00 |
| 1353744 | 1.00 |
| 1353747 | 1.50 |
| 1353809 | 0.00 |
| 1353877 | 0.00 |
| 1353892 | 0.00 |
| 1353950 | 0.00 |
| 1354003 | 0.00 |
| 1354037 | 1.00 |

TABLE 64

Tolerability scores in mice

| Compound No. | 3 hr. FOB |
|---|---|
| PBS | 0.00 |
| 1332192 | 0.00 |
| 1332197 | 0.00 |
| 1332204 | 0.00 |
| 1332209 | 0.00 |
| 1332210 | 0.00 |
| 1332212 | 0.00 |
| 1332213 | 0.00 |
| 1353645 | 0.00 |
| 1353763 | 0.00 |
| 1353889 | 0.00 |

TABLE 65

Tolerability scores in mice

| Compound No. | 3 hr. FOB |
|---|---|
| PBS | 0.00 |
| 1478904 | 0.00 |
| 1478907 | 0.00 |
| 1478908 | 0.00 |
| 1478909 | 0.00 |
| 1478910 | 0.25 |
| 1478913 | 1.00 |
| 1478919 | 0.75 |
| 1498061 | 4.75 |
| 1498072 | 5.00 |

TABLE 66

Tolerability scores in mice

| Compound No. | 3 hr. FOB |
|---|---|
| PBS | 0.00 |
| 1353977 | 1.00 |
| 1353993 | 2.75 |
| 1399125 | 1.00 |
| 1478914 | 1.00 |
| 1478920 | 1.00 |
| 1478921 | 0.00 |
| 1478922 | 1.00 |
| 1478923 | 1.25 |
| 1478924 | 0.00 |

TABLE 67

Tolerability scores in mice

| Compound No. | 3 hr. FOB |
|---|---|
| PBS | 0.00 |
| 1332169 | 1.00 |
| 1332200 | 1.00 |
| 1332207 | 0.00 |
| 1333927 | 6.33 |
| 1353643 | 1.00 |
| 1353760 | 0.00 |
| 1353776 | 0.67 |
| 1353802 | 0.00 |
| 1353818 | 0.00 |
| 1353869 | 0.00 |
| 1353981 | 1.00 |
| 1354046 | 0.00 |
| 1354060 | 0.00 |
| 1354072 | 0.33 |
| 1354075 | 0.00 |
| 1394454 | 2.33 |
| 1394455 | 1.67 |
| 1397904 | 2.33 |
| 1478925 | 0.00 |
| 1478926 | 1.33 |
| 1478927 | 0.33 |
| 1498064 | 1.00 |

TABLE 68

Tolerability scores in mice

| Compound No. | 3 hr. FOB |
|---|---|
| PBS | 0.00 |
| 1353658 | 1.00 |
| 1353681 | 0.00 |
| 1353690 | 0.67 |
| 1353694 | 0.00 |

TABLE 68-continued

Tolerability scores in mice

| Compound No. | 3 hr. FOB |
|---|---|
| 1353734 | 0.00 |
| 1353762 | 0.00 |
| 1353783 | 0.00 |
| 1353804 | 0.00 |
| 1353808 | 0.00 |
| 1353846 | 1.00 |
| 1353884 | 0.00 |
| 1353899 | 0.00 |
| 1353931 | 1.33 |
| 1353974 | 0.00 |
| 1354007 | 0.00 |
| 1354012 | 0.00 |
| 1354033 | 0.00 |
| 1354050 | 0.00 |
| 1354092 | 0.00 |
| 1397572 | 1.33 |
| 1397795 | 1.67 |
| 1397824 | 1.67 |
| 1398213 | 0.00 |
| 1398518 | 0.00 |
| 1398644 | 0.00 |
| 1399147 | 0.67 |
| 1399295 | 4.00 |

TABLE 69

Tolerability scores in mice

| Compound No. | 3 hr. FOB |
|---|---|
| PBS | 0.00 |
| 1353648 | 3.33 |
| 1353649 | 0.33 |
| 1353664 | 2.33 |
| 1353686 | 0.00 |
| 1353723 | 0.67 |
| 1353725 | 2.67 |
| 1353733 | 0.00 |
| 1353753 | 0.67 |
| 1353796 | 1.00 |
| 1353815 | 1.00 |
| 1353886 | 0.00 |
| 1353935 | 1.00 |
| 1353937 | 0.00 |
| 1353957 | 2.00 |
| 1353986 | 0.00 |
| 1353992 | 1.67 |
| 1353996 | 0.67 |
| 1354081 | 1.00 |

Example 8: Tolerability of Modified Oligonucleotides Comprising cEt Nucleosides Complementary to Human APP in Wild-Type Mice, 3 Hour Study Modified oligonucleotides described above were tested in wild-type female C57/Bl6 mice to assess the tolerability of the oligonucleotides. Wild-type female C57/Bl6 mice each received a single ICV dose of modified oligonucleotide at 300 µg. Each treatment group consisted of 2-4 mice. A group of 2-4 mice received PBS as a negative control for each experiment. Each experiment is identified in separate tables below. At 3 hours post-injection, mice were evaluated according to seven different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching; (7) regular breathing. For each of the 7 criteria, a mouse was given a subscore of 0 if it met the criteria and 1 if it did not (the functional observational battery score or FOB). After all 7 criteria were evaluated, the scores were summed for each mouse and averaged within each treatment group. The results are presented in the tables below.

TABLE 70

Tolerability scores in mice

| Compound No. | 3 hr. FOB |
|---|---|
| PBS | 0.00 |
| 1333912 | 4.50 |
| 1333913 | 5.00 |
| 1333914 | 5.50 |
| 1333915 | 4.00 |
| 1333916 | 6.00 |
| 1333917 | 5.00 |
| 1333918 | 1.00 |
| 1333919 | 1.00 |
| 1333920 | 1.00 |
| 1333921 | 1.00 |
| 1333922 | 1.00 |
| 1333923 | 1.00 |
| 1333924 | 1.00 |
| 1333925 | 1.00 |
| 1333926 | 1.00 |
| 1333927 | 4.50 |
| 1333928 | 5.00 |
| 1333929 | 1.00 |
| 1333930 | 1.00 |
| 1333931 | 4.00 |
| 1333932 | 4.50 |
| 1333933 | 3.00 |
| 1333934 | 5.00 |
| 1333935 | 1.00 |
| 1335695 | 1.00 |
| 1335696 | 4.00 |
| 1335697 | 1.00 |
| 1335698 | 3.00 |
| 1335699 | 1.00 |
| 1335700 | 2.00 |
| 1335701 | 1.00 |
| 1335702 | 1.00 |
| 1335703 | 4.00 |
| 1335704 | 4.00 |
| 1335705 | 1.00 |
| 1335706 | 2.00 |
| 1335707 | 6.00 |
| 1335708 | 1.00 |
| 1335709 | 1.00 |
| 1335710 | 3.50 |
| 1335711 | 3.50 |
| 1335712 | 5.00 |
| 1335713 | 1.00 |
| 1335714 | 1.00 |
| 1335715 | 6.50 |
| 1335716 | 4.50 |
| 1335717 | 4.00 |
| 1335718 | 3.50 |

Example 9: Tolerability of Modified Oligonucleotides Complementary to Human APP in Rats, 3 Hour Study Modified oligonucleotides described above were tested in rats to assess the tolerability of the oligonucleotides. Sprague Dawley rats each received a single intrathecal (IT) dose of oligonucleotide at doses indicated in the tables below. Compounds comprising MOE nucleosides were administered at a dose of 3 mg and compounds comprising cEt nucleosides were administered at a dose of 2.4 mg. Each treatment group consisted of 3 rats. A group of 3 rats received PBS as a negative control. Each experiment is identified in separate tables below. At 3 hours post-injection, movement in 7 different parts of the body were evaluated for each rat. The 7 body parts are (1) the rat's tail; (2) the rat's posterior posture; (3) the rat's hind limbs; (4) the rat's hind paws; (5) the rat's forepaws; (6) the rat's anterior posture; (7) the rat's head. For each of the 7 different body parts, each rat was given a sub-score of 0 if the body part was moving or 1 if the body part was paralyzed (the functional observational battery score or FOB). After each of the 7 body parts were evaluated, the sub-scores were summed for each rat and then averaged for each group. For example, if a rat's tail, head, and all other evaluated body parts were moving 3 hours after the 3 mg IT dose, it would receive a summed score of 0. If another rat was not moving its tail 3 hours after the 3 mg IT dose but all other evaluated body parts were moving, it would receive a score of 1. Results are presented as the average score for each treatment group.

TABLE 71

Tolerability scores in rats

| Compound No. | Dose (mg) | 3 hr. FOB |
|---|---|---|
| PBS | 0 | 0.00 |
| 1332179 | 3 | 1.33 |
| 1332199 | 3 | 1.33 |
| 1332201 | 3 | 3.00 |
| 1332202 | 3 | 3.00 |
| 1332204 | 3 | 0.67 |
| 1332207 | 3 | 1.00 |
| 1332212 | 3 | 0.00 |
| 1333926 | 2.4 | 2.33 |
| 1335708 | 2.4 | 3.00 |
| 1335714 | 2.4 | 3.00 |

TABLE 72

Tolerability scores in rats

| Compound No. | Dose (mg) | 3 hr. FOB |
|---|---|---|
| PBS | 0 | 0.00 |
| 1332173 | 3 | 3.00 |
| 1332182 | 3 | 2.00 |
| 1332183 | 3 | 3.67 |
| 1332187 | 3 | 1.67 |
| 1332189 | 3 | 0.33 |
| 1332192 | 3 | 0.33 |
| 1332196 | 3 | 1.67 |
| 1332197 | 3 | 0.33 |
| 1332198 | 3 | 1.67 |
| 1332200 | 3 | 3.00 |
| 1332206 | 3 | 5.00 |
| 1332208 | 3 | 0.67 |
| 1332209 | 3 | 0.33 |
| 1332210 | 3 | 0.33 |
| 1332211 | 3 | 2.00 |
| 1333924 | 2.4 | 1.33 |
| 1333927 | 2.4 | 1.33 |
| 1333932 | 2.4 | 4.67 |
| 1335696 | 2.4 | 5.00 |
| 1335700 | 2.4 | 0.33 |
| 1335704 | 2.4 | 5.67 |

TABLE 73

Tolerability scores in rats

| Compound No. | Dose (mg) | 3 hr. FOB |
|---|---|---|
| PBS | 0 | 0.00 |
| 1332169 | 3 | 2.33 |
| 1332176 | 3 | 0.67 |
| 1332181 | 3 | 4.33 |
| 1332186 | 2.4 | 2.00 |
| 1332193 | 3 | 0.33 |
| 1332195 | 3 | 2.33 |
| 1332203 | 3 | 1.33 |
| 1332213 | 3 | 0.67 |
| 1333925 | 3 | 3.67 |
| 1333931 | 3 | 4.67 |
| 1335695 | 2.4 | 2.67 |
| 1335697 | 2.4 | 3.00 |
| 1335703 | 2.4 | 4.33 |
| 1335706 | 2.4 | 5.67 |
| 1335718 | 2.4 | 3.33 |

TABLE 74

Tolerability scores in rats

| Compound No. | Dose (mg) | 3 hr. FOB |
|---|---|---|
| PBS | 0 | 0.00 |
| 1353641 | 3 | 0.00 |
| 1353642 | 3 | 0.00 |
| 1353643 | 3 | 2.00 |
| 1353645 | 3 | 0.00 |
| 1353692 | 3 | 0.67 |
| 1353730 | 3 | 0.67 |
| 1353731 | 3 | 0.33 |
| 1353750 | 3 | 0.00 |
| 1353760 | 3 | 1.67 |
| 1353763 | 3 | 0.00 |
| 1353776 | 3 | 2.67 |
| 1353802 | 3 | 1.33 |
| 1353818 | 3 | 1.67 |
| 1353828 | 3 | 0.33 |
| 1353844 | 3 | 4.33 |
| 1353869 | 3 | 2.00 |
| 1353889 | 3 | 0.00 |
| 1353953 | 3 | 1.00 |
| 1353956 | 3 | 0.00 |
| 1353962 | 3 | 0.67 |
| 1353972 | 3 | 0.33 |
| 1353977 | 3 | 1.67 |
| 1353981 | 3 | 1.67 |
| 1354008 | 3 | 0.00 |
| 1354020 | 3 | 0.00 |
| 1354030 | 3 | 1.00 |
| 1354046 | 3 | 1.67 |
| 1354060 | 3 | 0.33 |
| 1354072 | 3 | 1.67 |
| 1354075 | 3 | 0.00 |
| 1354092 | 3 | 0.00 |

TABLE 75

Tolerability scores in rats

| Compound No. | Dose (mg) | 3 hr. FOB |
|---|---|---|
| PBS | 0 | 0.00 |
| 1353648 | 3 | 1.33 |
| 1353658 | 3 | 1.33 |
| 1353664 | 3 | 2.67 |
| 1353681 | 3 | 0.00 |
| 1353690 | 3 | 0.00 |
| 1353694 | 3 | 0.00 |
| 1353725 | 3 | 2.00 |
| 1353734 | 3 | 0.67 |

TABLE 75-continued

Tolerability scores in rats

| Compound No. | Dose (mg) | 3 hr. FOB |
|---|---|---|
| 1353762 | 3 | 1.33 |
| 1353783 | 3 | 1.33 |
| 1353804 | 3 | 1.67 |
| 1353808 | 3 | 0.00 |
| 1353815 | 3 | 0.00 |
| 1353846 | 3 | 2.00 |
| 1353884 | 3 | 0.00 |
| 1353886 | 3 | 0.00 |
| 1353899 | 3 | 0.33 |
| 1353913 | 3 | 0.67 |
| 1353931 | 3 | 1.33 |
| 1353974 | 3 | 1.33 |
| 1353986 | 3 | 0.00 |
| 1353993 | 3 | 1.67 |
| 1354007 | 3 | 2.00 |
| 1354012 | 3 | 0.00 |
| 1354028 | 3 | 0.00 |
| 1354031 | 3 | 2.67 |
| 1354033 | 3 | 0.00 |
| 1354050 | 3 | 0.67 |

TABLE 76

Tolerability scores in rats

| Compound No. | Dose (mg) | 3 hr. FOB |
|---|---|---|
| PBS | 0 | 0.00 |
| 1353649 | 3 | 0.33 |
| 1353686 | 3 | 0.33 |
| 1353723 | 3 | 0.33 |
| 1353733 | 3 | 0.67 |
| 1353753 | 3 | 0.67 |
| 1353796 | 3 | 2.67 |
| 1353935 | 3 | 1.67 |
| 1353937 | 3 | 0.33 |
| 1353957 | 3 | 2.33 |
| 1353992 | 3 | 3.00 |
| 1353996 | 3 | 1.67 |
| 1354081 | 3 | 1.33 |

TABLE 77

Tolerability scores in rats

| Compound No. | Dose (mg) | 3 hr. FOB |
|---|---|---|
| PBS | 0 | 0.00 |
| 1397572 | 3 | 3.00 |
| 1397586 | 3 | 2.33 |
| 1397616 | 3 | 0.33 |
| 1397620 | 3 | 2.00 |
| 1397631 | 3 | 1.33 |
| 1397656 | 3 | 1.67 |
| 1397705 | 3 | 0.33 |
| 1397706 | 3 | 2.00 |
| 1397713 | 3 | 0.00 |
| 1397765 | 3 | 2.67 |
| 1397772 | 3 | 1.67 |
| 1397786 | 3 | 0.67 |
| 1397795 | 3 | 2.00 |
| 1397821 | 3 | 0.00 |
| 1397824 | 3 | 3.00 |
| 1397842 | 3 | 0.33 |
| 1397883 | 3 | 1.67 |
| 1397925 | 3 | 2.00 |
| 1397948 | 3 | 2.00 |
| 1398033 | 3 | 0.00 |
| 1398060 | 3 | 0.33 |
| 1398125 | 3 | 1.00 |
| 1398133 | 3 | 2.00 |

TABLE 77-continued

Tolerability scores in rats

| Compound No. | Dose (mg) | 3 hr. FOB |
|---|---|---|
| 1398203 | 3 | 0.00 |
| 1398213 | 3 | 0.33 |
| 1398227 | 3 | 0.00 |
| 1398341 | 3 | 0.33 |

TABLE 78

Tolerability scores in rats

| Compound No. | Dose (mg) | 3 hr. FOB |
|---|---|---|
| PBS | 0 | 0.00 |
| 1398342 | 3 | 2.33 |
| 1398371 | 3 | 0.00 |
| 1398406 | 3 | 0.00 |
| 1398429 | 3 | 0.00 |
| 1398440 | 3 | 0.00 |
| 1398456 | 3 | 3.00 |
| 1398518 | 3 | 0.33 |
| 1398534 | 3 | 0.00 |
| 1398539 | 3 | 0.00 |
| 1398550 | 3 | 2.00 |
| 1398644 | 3 | 2.00 |
| 1398681 | 3 | 0.00 |
| 1398686 | 3 | 1.00 |
| 1398748 | 3 | 0.00 |
| 1398760 | 3 | 2.33 |
| 1398762 | 3 | 0.00 |
| 1398806 | 3 | 0.00 |
| 1398829 | 3 | 0.67 |
| 1398830 | 3 | 0.00 |
| 1398916 | 3 | 1.67 |
| 1398955 | 3 | 0.00 |
| 1399000 | 3 | 1.67 |
| 1399010 | 3 | 0.00 |
| 1399025 | 3 | 0.33 |
| 1399026 | 3 | 0.00 |

TABLE 79

Tolerability scores in rats

| Compound No. | Dose (mg) | 3 hr. FOB |
|---|---|---|
| PBS | 0 | 0.00 |
| 1332171 | 3 | 1.33 |
| 1332194 | 3 | 0.67 |
| 1335713 | 3 | 3.33 |
| 1353640 | 3 | 3.33 |
| 1353707 | 3 | 3.33 |
| 1353716 | 3 | 0.33 |
| 1353744 | 3 | 2.33 |
| 1353747 | 3 | 2.33 |
| 1353809 | 3 | 2.00 |
| 1399141 | 3 | 2.00 |
| 1399147 | 3 | 0.67 |
| 1399164 | 3 | 0.33 |
| 1399176 | 3 | 0.00 |
| 1399198 | 3 | 2.00 |
| 1399200 | 3 | 1.00 |
| 1399215 | 3 | 0.00 |
| 1399216 | 3 | 0.00 |
| 1399291 | 3 | 0.00 |
| 1399295 | 3 | 4.33 |
| 1399365 | 3 | 0.33 |
| 1399380 | 3 | 0.00 |
| 1399404 | 3 | 0.00 |
| 1399427 | 3 | 0.00 |
| 1399430 | 3 | 1.00 |
| 1399473 | 3 | 0.33 |

TABLE 79-continued

Tolerability scores in rats

| Compound No. | Dose (mg) | 3 hr. FOB |
|---|---|---|
| 1399500 | 3 | 0.33 |
| 1399511 | 3 | 1.33 |

TABLE 80

Tolerability scores in rats

| Compound No. | Dose (mg) | 3 hr. FOB |
|---|---|---|
| PBS | 0 | 0.00 |
| 1332192 | 3 | 0.33 |
| 1332204 | 3 | 0.00 |
| 1353877 | 3 | 0.00 |
| 1353892 | 3 | 2.00 |
| 1353985 | 3 | 0.00 |
| 1354003 | 3 | 1.33 |
| 1399125 | 3 | 2.00 |
| 1478902 | 3 | 1.67 |
| 1478903 | 3 | 2.00 |
| 1478904 | 3 | 0.00 |
| 1478905 | 3 | 0.67 |
| 1478906 | 3 | 1.67 |
| 1478907 | 3 | 0.67 |
| 1478908 | 3 | 0.33 |
| 1478909 | 3 | 0.33 |
| 1478910 | 3 | 0.00 |
| 1478911 | 3 | 1.00 |
| 1478912 | 3 | 0.00 |
| 1478913 | 3 | 0.33 |

TABLE 81

Tolerability scores in rats

| Compound No. | Dose (mg) | 3 hr. FOB |
|---|---|---|
| PBS | 0 | 0.00 |
| 1478917 | 3 | 0.00 |
| 1478919 | 3 | 0.00 |
| 1478925 | 3 | 0.33 |
| 1478926 | 3 | 0.67 |
| 1478914 | 3 | 0.33 |
| 1478920 | 3 | 0.00 |
| 1478921 | 3 | 0.00 |
| 1478922 | 3 | 0.00 |
| 1478923 | 3 | 0.00 |
| 1478924 | 3 | 0.00 |
| 1478927 | 3 | 0.67 |

TABLE 82

Tolerability scores in rats

| Compound No. | Dose (mg) | 3 hr. FOB |
|---|---|---|
| PBS | 0 | 0.00 |
| 1394454 | 3 | 2.33 |
| 1394455 | 3 | 3.00 |
| 1397904 | 3 | 4.67 |
| 1498061 | 3 | 3.33 |
| 1498069 | 3 | 4.00 |
| 1498072 | 3 | 3.00 |
| 1498064 | 3 | 1.00 |

Example 10: Activity of Modified Oligonucleotides Complementary to Human APP in Tc1 Transgenic Mice The aneuploid mouse line (Tc1), expressing human APP, previously described in O'Doherty A., et al., *An Aneuploid Mouse Strain Carrying Human Chromosome 21 with Down Syndrome Phenotypes*, Science 2005, 309(5743): 2033-2037, was used to test activity of modified oligonucleotides described above.

Treatment

Tc1 mice were divided into groups of 2-3 mice each (the n for each study is indicated in the tables below). Each mouse received a single ICV bolus of 300 μg of modified oligonucleotide. A group of 3-4 mice received PBS as a negative control.

RNA Analysis

Two weeks post treatment, mice were sacrificed, and RNA was extracted from cortical brain tissue and spinal cord for RTPCR analysis to measure amount of APP RNA using human primer probe set RTS35571 (forward sequence CCCACTTTGTGATTCCCTACC, designated herein as SEQ ID NO: 17; reverse sequence ATCCATCCTCTCCTGGTGTAA, designated herein as SEQ ID NO: 18; probe sequence TGATGCCCTTCTCGTTCCTGACAA, designated herein as SEQ ID NO: 19). Results are presented as percent human APP RNA relative to PBS control, normalized to mouse cyclophilin A. Mouse cyclophilin A was amplified using primer probe set m_cyclo24 (forward sequence TCGCCGCTTGCTGCA, designated herein as SEQ ID NO: 20; reverse sequence ATCGGCCGTGATGTCGA, designated herein as SEQ ID NO: 21; probe sequence CCATGGTCAACCCCACCGTGTTC, designated herein as SEQ ID NO: 22).

The values marked by the symbol "†" indicate that the modified oligonucleotide is complementary to the amplicon region of the primer probe set. In such cases, human primer probe set RTS35572 (described herein above), or the human primer probe set HS.PT.56a.38768352 (Integrated DNA Technologies, Inc.) were used to further assess the activity of the modified oligonucleotides.

TABLE 83

Reduction of human APP RNA in Tc1 transgenic mice, n = 2

| | APP RNA (% control) RTS35571 | | APP RNA (% control) RTS35572 | |
|---|---|---|---|---|
| Compound No. | SPINAL CORD | CORTEX | SPINAL CORD | CORTEX |
| PBS | 100 | 100 | 100 | 100 |
| 1332176 | 117 | 94 | 110 | 96 |
| 1332179 | 87 | 75 | 91 | 79 |
| 1332192 | 42 | 40 | 61‡ | 41 |
| 1332193 | 73 | 56 | 72 | 53 |
| 1332197 | 72 | 77 | 78 | 79 |
| 1332204 | 59 | 46 | 59 | 38 |
| 1332208 | 109 | 94 | 98 | 90 |
| 1332209 | 66 | 51 | 68 | 52 |
| 1332210 | 63 | 37 | 42 | 45 |
| 1332212 | 75† | 22† | 67 | 30 |
| 1332213 | 149† | 92† | 76 | 43 |
| 1335700 | 113 | 129 | 111 | 113 |
| 1353641 | 100 | 109 | 98 | 100 |
| 1353642 | 95 | 90 | 95 | 92 |
| 1353645 | 51 | 41 | 52 | 43 |
| 1353692 | 89 | 78 | 90 | 80 |
| 1353730 | 104 | 129 | 107 | 123 |

TABLE 83-continued

Reduction of human APP RNA in Tc1 transgenic mice, n = 2

| | APP RNA (% control) RTS35571 | | APP RNA (% control) RTS35572 | |
|---|---|---|---|---|
| Compound No. | SPINAL CORD | CORTEX | SPINAL CORD | CORTEX |
| 1353731 | 85 | 104 | 81 | 86 |
| 1353750 | 69 | 81 | 71 | 87 |
| 1353763 | 80 | 66 | 84 | 61 |
| 1353828 | 84 | 85 | 80 | 82 |
| 1353889 | 59 | 63 | 63 | 61 |
| 1353953 | 86 | 94 | 90 | 95 |
| 1353956 | 84 | 78 | 88 | 75 |
| 1353962 | 60 | 52 | 62 | 55 |
| 1353972 | 63 | 60 | 70 | 62 |
| 1354008 | 65 | 58 | 68 | 59 |
| 1354020 | 81 | 96 | 85 | 96 |
| 1354030 | 62 | 60 | 66 | 66 |

TABLE 84

Reduction of human APP RNA in Tc1 transgenic mice, n = 2

| | APP RNA (% control) RTS35571 | |
|---|---|---|
| Compound No. | SPINAL CORD | CORTEX |
| PBS | 100 | 100 |
| 1332173 | 94 | 74 |
| 1332182 | 72 | 67 |
| 1332186 | 79 | 72 |
| 1332187 | 101 | 85 |
| 1332195 | 102 | 88 |
| 1332196 | 88 | 99 |
| 1332198 | 101 | 84 |
| 1332211 | 70 | 71 |
| 1333924 | 95 | 101 |
| 1333926 | 27 | 22 |
| 1335695 | 82 | 124 |
| 1335697 | 110 | 113 |
| 1335713 | 32 | 26 |
| 1335714 | 61 | 78 |

TABLE 85

Reduction of human APP RNA in Tc1 transgenic mice, n = 2

| | APP RNA (% control) RTS35571 | | APP RNA (% control) HS.PT.56a.38768352 | |
|---|---|---|---|---|
| Compound No. | SPINAL CORD | CORTEX | SPINAL CORD | CORTEX |
| PBS | 100 | 100 | 100 | 100 |
| 1333919 | 40 | 32 | 36 | 29 |
| 1335708 | 35 | 38 | 29 | 34 |
| 1353707 | 77 | 64 | 77 | 66 |
| 1353985 | 64† | 56† | 68 | 61 |
| 1478902 | 67† | 72† | 79 | 79 |
| 1478903 | 33 | 63‡ | 45‡ | 58‡ |
| 1478904 | 54 | 32‡ | 51‡ | 32‡ |
| 1478905 | 59 | 51 | 56 | 47 |
| 1478906 | 58 | 51 | 57 | 52 |
| 1478907 | 59 | 41 | 58 | 42 |
| 1478908 | 71† | 50† | 69 | 58 |
| 1478909 | 55 | 50 | 50 | 48 |
| 1478910 | 61 | 42 | 61 | 42 |
| 1478911 | 69 | 55 | 63 | 52 |
| 1478912 | 62 | 57 | 61 | 56 |
| 1478913 | 63 | 48 | 62 | 49 |
| 1478917 | 81 | 84 | 74 | 80 |

TABLE 85-continued

Reduction of human APP RNA in Tc1 transgenic mice, n = 2

| | APP RNA (% control) RTS35571 | | APP RNA (% control) HS.PT.56a.38768352 | |
|---|---|---|---|---|
| Compound No. | SPINAL CORD | CORTEX | SPINAL CORD | CORTEX |
| 1478919 | 35† | 21† | 47 | 33 |
| 1332212 | 42† | 28† | 47 | 36 |

‡indicates that fewer than 2 samples were available for PCR

TABLE 86

Reduction of human APP RNA in Tc1 transgenic mice, n = 2

| | APP RNA (% control) RTS35571 | |
|---|---|---|
| Compound No. | SPINAL CORD | CORTEX |
| PBS | 100 | 100 |
| 1498059 | 52 | 55 |
| 1498060 | 57‡ | 62‡ |
| 1498061 | 71‡ | 42‡ |
| 1498065 | 68 | 62 |
| 1498066 | 50‡ | 81‡ |
| 1498067 | 62 | 59 |
| 1498068 | 54‡ | 61 |
| 1498069 | 66 | 84 |
| 1498070 | 69 | 68 |
| 1498071 | 65 | 57 |
| 1498072 | 42‡ | 46 |
| 1498073 | 52 | 51 |
| 1498105 | 62 | 52 |
| 1498106 | 81 | 73 |
| 1498058 | 53 | 51 |
| 1498062 | 86‡ | 76 |

‡indicates that fewer than 2 samples were available for PCR

TABLE 87

Reduction of human APP RNA in Tc1 transgenic mice, n = 3

| | APP RNA (% control) RTS35571 | |
|---|---|---|
| Compound No. | SPINAL CORD | CORTEX |
| PBS | 100 | 100 |
| 1332204 | 65‡ | 53 |
| 1332209 | 73 | 56 |
| 1332210 | 58 | 53 |
| 1353645 | 59 | 47 |
| 1478919 | 49 | 22 |
| 1478908 | 49 | 29 |
| 1478904 | 54 | 35 |

‡indicates that fewer than 3 samples were available for PCR

TABLE 88

Reduction of human APP RNA in Tc1 transgenic mice, n = 2

| | APP RNA (% control) RTS35571 | |
|---|---|---|
| Compound No. | SPINAL CORD | CORTEX |
| PBS | 100 | 100 |
| 1332169 | 82 | 79 |
| 1353686 | 34 | 30 |
| 1353694 | 62 | 69 |
| 1353723 | 75 | 85 |

TABLE 88-continued

Reduction of human APP RNA in Tc1 transgenic mice, n = 2

| Compound No. | APP RNA (% control) RTS35571 | |
|---|---|---|
| | SPINAL CORD | CORTEX |
| 1353733 | 39 | 45 |
| 1353760 | 63 | 70 |
| 1353776 | 92 | 104 |
| 1353802 | 61 | 59 |
| 1353815 | 30 | 42 |
| 1353818 | 68 | 80 |
| 1353869 | 70 | 77 |
| 1353884 | 45 | 37 |
| 1353899 | 50 | 51 |
| 1353913 | 34 | 30 |
| 1353977 | 73 | 88 |
| 1353981 | 78 | 84 |
| 1353993 | 52 | 72 |
| 1354007 | 54 | 64 |
| 1354060 | 49 | 45 |
| 1354072 | 62 | 65 |
| 1354075 | 80 | 79 |
| 1354081 | 50 | 60 |
| 1354092 | 70 | 84 |
| 1397620 | 47 | 64 |
| 1397772 | 44 | 35 |
| 1397824 | 40 | 57 |
| 1398203 | 48 | 51 |
| 1398227 | 35 | 33 |
| 1398440 | 41 | 46 |
| 1398456 | 44 | 25 |
| 1398681 | 42 | 41 |
| 1399147 | 57 | 70 |
| 1399164 | 40 | 42 |
| 1399176 | 41 | 44 |
| 1399404 | 55 | 64 |
| 1478925 | 75 | 98 |
| 1478926 | 91 | 103 |

Example 11: Design of Modified Oligonucleotides Complementary to Human APP Nucleic Acid Modified oligonucleotides complementary to a human APP nucleic acid were designed, as described in the table below. "Start site" indicates the 5'-most nucleoside to which the modified oligonucleotide is complementary in the target nucleic acid sequence. "Stop site" indicates the 3'-most nucleoside to which the modified oligonucleotide is complementary in the target nucleic acid sequence. Each modified oligonucleotide listed in the tables below is 100% complementary to SEQ ID NO: 1 (described herein above), to SEQ ID NO: 2 (described herein above), or to both. 'N/A' indicates that the modified oligonucleotide is not 100% complementary to that particular target nucleic acid sequence.

The modified oligonucleotides in the table below are 5-10-5 MOE gapmers. The gapmers are 20 nucleosides in length, wherein the sugar motif for the gapmers is (from 5' to 3'): eeeeedddddddddddeeeee; wherein each 'd' represents a 2'-β-D-deoxyribosyl sugar moiety, and each 'e' represents a 2'-MOE sugar moiety. The gapmers have an internucleoside linkage motif of (from 5' to 3'): sooosssssssssssooss; wherein each "s" represents a phosphorothioate internucleoside linkage, and each "o" represents a phosphodiester internucleoside linkage. Each cytosine residue is a 5-methyl cytosine.

TABLE 89

5-10-5 MOE gapmers with mixed PO/PS internucleoside linkages complementary to human APP

| Compound Number | SEQ ID No: 1 Start Site | SEQ ID No: 1 Stop Site | SEQ ID No: 2 Start Site | SEQ ID No: 2 Stop Site | Sequence (5' to 3') | SEQ ID NO |
|---|---|---|---|---|---|---|
| 1478914 | 184 | 203 | 61947 | 61966 | ATGGATCTGAATCCCACTTC | 3040 |
| 1478920 | 387 | 406 | N/A | N/A | ACTTACAAACTCACCAACTA | 3041 |
| 1478921 | 386 | 405 | N/A | N/A | CTTACAAACTCACCAACTAA | 3042 |
| 1478922 | 1346 | 1365 | 198785 | 198804 | TGTTCCAAAGATTCCACTTT | 3043 |
| 1478923 | 1345 | 1364 | 198784 | 198803 | GTTCCAAAGATTCCACTTTC | 3044 |
| 1478924 | 1344 | 1363 | 198783 | 198802 | TTCCAAAGATTCCACTTTCT | 3045 |
| 1478927 | N/A | N/A | 25098 | 25117 | TTACATCATTTTCTTGCAGT | 3046 |
| 1539237 | N/A | N/A | 158797 | 158816 | TGGTTTACCTTTAACATTCC | 3047 |
| 1539238 | N/A | N/A | 158796 | 158815 | GGTTTACCTTTAACATTCCT | 3048 |
| 1539239 | N/A | N/A | 158794 | 158813 | TTTACCTTTAACATTCCTCA | 3049 |
| 1539240 | N/A | N/A | 158793 | 158812 | TTACCTTTAACATTCCTCAT | 3050 |
| 1539241 | N/A | N/A | 282311 | 282330 | TCTCTCATAGTCTTAATTCC | 3051 |
| 1539242 | N/A | N/A | 282309 | 282328 | TCTCATAGTCTTAATTCCCA | 3052 |

TABLE 89-continued 5-10-5 MOE gapmers with mixed PO/PS internucleoside linkages
complementary to human APP

| Compound Number | SEQ ID No: 1 Start Site | SEQ ID No: 1 Stop Site | SEQ ID No: 2 Start Site | SEQ ID No: 2 Stop Site | Sequence (5' to 3') | SEQ ID NO |
|---|---|---|---|---|---|---|
| 1539243 | N/A | N/A | 34555 | 34574 | TCCAATTTTAACTTGCACCA | 3053 |
| 1539244 | N/A | N/A | 159758 | 159777 | TTCACAGTTTACCCCAAGCT | 3054 |
| 1539245 | N/A | N/A | 159757 | 159776 | TCACAGTTTACCCCAAGCTT | 3055 |
| 1539246 | N/A | N/A | 12585 | 12604 | CATTCTCTTATATTCCTTAC | 3056 |

The modified oligonucleotide in the table below is a 5-10-5 MOE gapmer. The gapmer is 20 nucleosides in length, wherein the sugar motif for the gapmer is (from 5' to 3'): eeeeedddddddddddeeeee; wherein each 'd' represents a 2'-β-D-deoxyribosyl sugar moiety, and each 'e' represents a 2'-MOE sugar moiety. The gapmer has an internucleoside linkage motif of (from 5' to 3'): sooossssssssssssooos; wherein each "s" represents a phosphorothioate internucleoside linkage, and each "o" represents a phosphodiester internucleoside linkage. Each cytosine residue is a 5-methyl cytosine.

TABLE 90

5-10-5 MOE gapmers with mixed PO/PS internucleoside linkages
complementary to human APP

| Compound Number | SEQ ID No: 1 Start Site | SEQ ID No: 1 Stop Site | SEQ ID No: 2 Start Site | SEQ ID No: 2 Stop Site | Sequence (5' to 3') | SEQ ID NO |
|---|---|---|---|---|---|---|
| 1532152 | 393 | 412 | 120656 | 120675 | GGCATCACTTACAAACTCAC | 3033 |

The modified oligonucleotides in the table below are 6-10-4 MOE gapmers. The gapmers are 20 nucleosides in length, wherein the sugar motif for the gapmers is (from 5' to 3'): eeeeeedddddddddeeee; wherein each 'd' represents a 2'-β-D-deoxyribosyl sugar moiety, and each 'e' represents a 2'-MOE sugar moiety. The gapmers have an internucleoside linkage motif of (from 5' to 3'): sooooosssssssssssoss; wherein each "s" represents a phosphorothioate internucleoside linkage, and each "o" represents a phosphodiester internucleoside linkage. Each cytosine residue is a 5-methyl cytosine.

TABLE 91

6-10-4 MOE gapmers with mixed PO/PS internucleoside linkages
complementary to human APP

| Compound Number | SEQ ID No: 1 Start Site | SEQ ID No: 1 Stop Site | SEQ ID No: 2 Start Site | SEQ ID No: 2 Stop Site | Sequence (5' to 3') | SEQ ID NO |
|---|---|---|---|---|---|---|
| 1498064 | 1997 | 2016 | 276327 | 276346 | ATATTTGTCAACCCAGAACC | 3057 |
| 1532149 | 393 | 412 | 120656 | 120675 | GGCATCACTTACAAACTCAC | 3033 |

The modified oligonucleotides in the table below are 6-10-4 MOE gapmers. The gapmers are 20 nucleosides in length, wherein the sugar motif for the gapmers is (from 5' to 3'): eeeeeedddddddddeeee; wherein each 'd' represents a 2'-β-D-deoxyribosyl sugar moiety, and each 'e' represents a 2'-MOE sugar moiety. The gapmers have an internucleoside linkage motif of (from 5' to 3'): sooooossssssssssoss; wherein each "s" represents a phosphorothioate internucleoside linkage, and each "o" represents a phosphodiester internucleoside linkage. Each cytosine residue is a 5-methyl cytosine.

TABLE 92

5-10-5 MOE gapmers with mixed PO/PS internucleoside linkages complementary to human APP

| Compound Number | SEQ ID No: 1 Start Site | SEQ ID No: 1 Stop Site | SEQ ID No: 2 Start Site | SEQ ID No: 2 Stop Site | Sequence (5' to 3') | SEQ ID NO |
|---|---|---|---|---|---|---|
| 1532150 | 393 | 412 | 120656 | 120675 | GGCATCACTTACAAACTCAC | 3033 |
| 1539865 | N/A | N/A | 282310 | 282329 | CTCTCATAGTCTTAATTCCC | 1896 |
| 1539866 | N/A | N/A | 178598 | 178617 | ATGTGATTTCACTAACCGGC | 238 |
| 1539867 | N/A | N/A | 158795 | 158814 | GTTTACCTTTAACATTCCTC | 452 |
| 1539868 | N/A | N/A | 159759 | 159778 | GTTCACAGTTTACCCCAAGC | 2225 |
| 1539869 | N/A | N/A | 34556 | 34575 | CTCCAATTTTAACTTGCACC | 1064 |
| 1539870 | N/A | N/A | 12586 | 12605 | GCATTCTCTTATATTCCTTA | 273 |

Example 12: Activity of Modified Oligonucleotides Complementary to Human APP in Tc1 Transgenic Mice The aneuploid mouse line (Tc1), expressing human APP, previously described in O'Doherty A., et al., *An Aneuploid Mouse Strain Carrying Human Chromosome 21 with Down Syndrome Phenotypes*, Science 2005, 309(5743): 2033-2037, was used to test activity of modified oligonucleotides described above.

Treatment

Tc1 mice were divided into groups of 2 mice each. Each mouse received a single ICV bolus of 300 μg of modified oligonucleotide. A group of 3-4 mice received PBS as a negative control.

RNA Analysis

Two weeks post treatment, mice were sacrificed, and RNA was extracted from cortical brain tissue and spinal cord for RTPCR analysis to measure amount of APP RNA using human primer probe set RTS35571 (described herein above). Results are presented as percent human APP RNA relative to PBS control, normalized to mouse cyclophilin A. The values marked by the symbol "‡" indicate that the modified oligonucleotide is complementary to the amplicon region of the primer probe set. In such cases, human primer probe set HS.PT.56a.38768352 (Integrated DNA Technologies, Inc.) were used to further assess the activity of the modified oligonucleotides.

TABLE 93

Reduction of human APP RNA in Tc1 transgenic mice, n = 2

| | APP RNA (% control) RTS35571 | |
|---|---|---|
| Compound No. | SPINAL CORD | CORTEX |
| PBS | 100 | 100 |
| 1353648 | 61 | 65 |
| 1353658 | 69 | 74 |

TABLE 93-continued

Reduction of human APP RNA in Tc1 transgenic mice, n = 2

| | APP RNA (% control) RTS35571 | |
|---|---|---|
| Compound No. | SPINAL CORD | CORTEX |
| 1353664 | 55 | 65 |
| 1353681 | 53‡ | 55 |
| 1353690 | 52 | 57 |
| 1353725 | 74 | 67 |
| 1353753 | 65 | 73 |
| 1353762 | 45 | 49 |
| 1353783 | 68 | 78 |
| 1353796 | 44 | 58 |
| 1353804 | 59 | 72 |
| 1353808 | 63 | 61 |
| 1353886 | 46 | 39 |
| 1353931 | 36 | 25 |
| 1353957 | 50 | 51 |
| 1353974 | 47 | 43 |
| 1353986 | 69 | 51 |
| 1353992 | 63 | 76 |
| 1354050 | 88 | 90 |
| 1397572 | 56 | 42 |
| 1398213 | 70 | 64 |

‡Indicates that fewer than 2 samples were available for PCR

TABLE 94

Reduction of human APP RNA in Tc1 transgenic mice, n = 2

| Compound No. | APP RNA (% control) RTS35571 | | APP RNA (% control) HS.PT.56a.38768352 | |
|---|---|---|---|---|
| | SPINAL CORD | CORTEX | SPINAL CORD | CORTEX |
| PBS | 100 | 100 | 100 | 100 |
| 1353643 | 36 | 44 | 37 | 40 |
| 1353649 | 68 | 96 | 71 | 95 |
| 1353734 | 77 | 98 | 76 | 89 |
| 1353937 | 69 | 99 | 66 | 94 |
| 1354012 | 54 | 60 | 54 | 63 |
| 1354033 | 54 | 79 | 53 | 81 |
| 1354046 | 57 | 123 | 61 | 111 |
| 1394454 | 38 | 70 | 42 | 69 |
| 1397631 | 43 | 81 | 41 | 78 |
| 1397656 | 55 | 104 | 56 | 96 |
| 1397706 | 47 | 64 | 46 | 67 |
| 1397713 | 61 | 106 | 60 | 94 |
| 1397765 | 51 | 106 | 48 | 90 |
| 1397786 | 25 | 61 | 29 | 60 |
| 1397883 | 37 | 91 | 40 | 86 |
| 1398371 | 37 | 84 | 38 | 83 |
| 1398406 | 45‡ | 86‡ | 46‡ | 84‡ |
| 1398429 | 40 | 82 | 39 | 74 |
| 1398539 | 25 | 69 | 26 | 53 |
| 1398686 | 56 | 145 | 52 | 109 |
| 1398830 | 47 | 147 | 49 | 96 |
| 1398955 | 46 | 85 | 48 | 79 |
| 1399000 | 49 | 135 | 52 | 104 |
| 1399033 | 23 | 40 | 25 | 44 |
| 1399365 | 39 | 123 | 38 | 97 |
| 1399380 | 35 | 108 | 40 | 90 |
| 1399473 | 56 | 96 | 56 | 101 |
| 1399500 | 53 | 114 | 56 | 99 |
| 1399511 | 46 | 102 | 47 | 83 |
| 1478914 | 44 | 108 | 51 | 94 |
| 1478920 | 41† | 106† | 48 | 86 |
| 1478921 | 51† | 97† | 50 | 89 |
| 1478927 | 26 | 66 | 30 | 67 |
| 1498064 | 42 | 107 | 46 | 90 |
| 1532149 | 20 | 34 | 31 | 49 |
| 1532150 | 11 | 20 | 21 | 44 |
| 1532152 | 16 | 40 | 25 | 53 |
| 1539237 | 38 | 83 | 38 | 82 |
| 1539238 | 24 | 82 | 35 | 89 |
| 1539239 | 27 | 63 | 36 | 63 |
| 1539240 | 27 | 79 | 45 | 69 |
| 1539241 | 26 | 67 | 30 | 75 |
| 1539242 | 20 | 53 | 27 | 52 |
| 1539243 | 27 | 53 | 30 | 56 |
| 1539244 | 29 | 71 | 29 | 71 |
| 1539245 | 19 | 53 | 24 | 62 |
| 1539246 | 35‡ | 81‡ | 54‡ | 90‡ |
| 1539865 | 24 | 39 | 26 | 43 |
| 1539866 | 27 | 94 | 33 | 102 |
| 1539867 | 24 | 33 | 22 | 30 |
| 1539868 | 20 | 40 | 19 | 36 |
| 1539869 | 20 | 33 | 18 | 36 |
| 1539870 | 22 | 48 | 21 | 62 |

‡Indicates that fewer than 2 samples were available for PCR

Example 13: Activity of Modified Oligonucleotides Complementary to Human APP in YAC-APP Transgenic Mice, Single Dose YAC transgenic mice, expressing human APP with London V717I and Swedish K670N/M671L mutations (YAC-APP transgenic mice), previously described in Lamb B., et al., *Altered metabolism of familial Alzheimer's disease-linked amyloid precursor protein variants in yeast artificial chromosome transgenic mice*. Hum Mol Genet 1997 September; 6(9): 1535-41, were used to test activity of modified oligonucleotides described above.

Treatment

YAC-APP transgenic mice were divided into groups of 2 mice each. Each mouse received a single ICV bolus of 300 µg of modified oligonucleotide. A group of 3-4 mice received PBS as a negative control.

RNA Analysis

Two weeks post treatment, mice were sacrificed, and RNA was extracted from cortical brain tissue and spinal cord for RTPCR analysis to measure amount of APP RNA using human primer probe set RTS35571 (described herein above). Results are presented as percent human APP RNA relative to PBS control, normalized to mouse cyclophilin A. The values marked by the symbol "f" indicate that the modified oligonucleotide is complementary to the amplicon region of the primer probe set. In such cases, human primer probe set HS.PT.56a.38768352 (Integrated DNA Technologies, Inc.) was used to further assess the activity of the modified oligonucleotides.

TABLE 95

Reduction of human APP RNA in YAC-APP transgenic mice, n = 2

| Compound No. | APP RNA (% control) RTS35571 | | APP RNA (% control) HS.PT.56a.38768352 | |
|---|---|---|---|---|
| | SPINAL CORD | CORTEX | SPINAL CORD | CORTEX |
| PBS | 100 | 100 | 100 | 100 |
| 1332176 | 69 | 69 | 72 | 72 |
| 1332194 | 92 | 80 | 99 | 79 |
| 1332208 | 86 | 75 | 88 | 80 |
| 1332212 | 36† | 61† | 41 | 68 |
| 1353686 | 22 | 42 | 22 | 44 |
| 1353884 | 28 | 37 | 27 | 40 |
| 1353886 | 37 | 55 | 38 | 61 |
| 1353931 | 39 | 44 | 44 | 51 |
| 1397772 | 37 | 56 | 38 | 58 |
| 1398227 | 28 | 25 | 28 | 27 |
| 1398456 | 20 | 36 | 19 | 37 |
| 1498064 | 84 | 87 | 83 | 91 |
| 1532149 | 37† | 36† | 52 | 59 |
| 1532150 | 28† | 29† | 44 | 57 |
| 1532152 | 43† | 30† | 50 | 47 |

TABLE 96

Reduction of human APP RNA in YAC-APP transgenic mice, n = 2

| | APP RNA (% control) RTS35571 | |
|---|---|---|
| Compound No. | SPINAL CORD | CORTEX |
| PBS | 100 | 100 |
| 1332183 | 79 | 106 |
| 1353643 | 27 | 73 |
| 1353677 | 69 | 30‡ |
| 1353734 | 70 | 101 |
| 1353759 | 76 | 108 |
| 1353762 | 32 | 54 |
| 1353785 | 65 | 78 |
| 1353796 | 38 | 67 |
| 1353850 | 56 | 96 |
| 1353974 | 39 | 70 |
| 1354002 | 73 | 70 |
| 1354035 | 39 | 35 |
| 1354046 | 62 | 85 |
| 1354059 | 65 | 92 |
| 1394453 | 70 | 81 |
| 1398198 | 80 | 80 |
| 1398644 | 46 | 62 |

‡Indicates that fewer than 2 samples available

TABLE 97

Reduction of human APP RNA in
YAC-APP transgenic mice, n = 2

| Compound No. | APP RNA (% control) RTS35571 | |
|---|---|---|
| | SPINAL CORD | CORTEX |
| PBS | 100 | 100 |
| 1332192 | 61 | 74 |
| 1353677 | 34 | 34 |

TABLE 97-continued

Reduction of human APP RNA in
YAC-APP transgenic mice, n = 2

| Compound No. | APP RNA (% control) RTS35571 | |
|---|---|---|
| | SPINAL CORD | CORTEX |
| 1353913 | 50 | 60 |
| 1398005 | 48 | 69 |
| 1398089 | 40 | 61 |
| 1398269 | 38 | 31 |
| 1399033 | 37 | 44 |
| 1478922 | 90 | 92 |
| 1478923 | 69 | 83 |
| 1478924 | 70 | 78 |
| 1539865 | 31 | 38 |

Example 14: Activity of Modified Oligonucleotides Complementary to Human APP in YAC-APP Transgenic Mice, Multiple Dose YAC-APP transgenic mice, described herein above, were used to test activity of modified oligonucleotides described above.

Treatment

YAC-APP transgenic mice were divided into groups of 4 mice each. Each mouse received a single ICV bolus of 30 μg, 100 μg, 300 μg or 700 μg of modified oligonucleotide. A group of 4 mice received PBS as a negative control.

RNA Analysis

Two weeks post treatment, mice were sacrificed, and RNA was extracted from cortical brain tissue and spinal cord for quantitative real time RTPCR analysis to measure amount of APP RNA using human primer probe set RTS35571 (described herein above). Results are presented as percent human APP RNA relative to PBS control, normalized to mouse cyclophilin A. ED50 were calculated from log transformed dose and individual animal mRNA levels using the built in GraphPad formula "log(agonist) vs. response—Find ECanything", with the following constraints: bottom=0, top=100, and F=50.

TABLE 98

Dose-dependent reduction of human APP RNA in YAC-APP transgenic mice

| Compound ID | Dose (μg) | Spinal Cord | | Cortex | | Hippocampus | |
|---|---|---|---|---|---|---|---|
| | | APP RNA (% control) | ED50 (μg) | APP RNA (% control) | ED50 (μg) | APP RNA (% control) | ED50 (μg) |
| 1353884 | 30 | 70 | 70 | 57 | 81 | 65 | 82 |
| | 100 | 38 | | 60 | | 48 | |
| | 300 | 22‡ | | 29 | | 33 | |
| | 700 | 20 | | 11 | | 15 | |
| 1397772 | 30 | 58 | 81 | 75 | 347 | 67 | 381 |
| | 100 | 56 | | 70 | | 68 | |
| | 300 | 46 | | 48 | | 53 | |
| | 700 | 35 | | 42 | | 42 | |
| 1398227 | 30 | 76 | 96 | 82 | 124 | 92 | 156 |
| | 100 | 46 | | 46 | | 55 | |
| | 300 | 28 | | 36 | | 33 | |
| | 700 | 18 | | 21 | | 23 | |
| 1398456 | 30 | 74 | 73 | 81 | 96 | 43 | 19 |
| | 100 | 37 | | 44 | | 36 | |
| | 300 | 20 | | 24 | | 23 | |
| | 700 | 16 | | 13 | | 15 | |

‡Indicates that fewer than 4 samples available

Example 15: Tolerability of Modified Oligonucleotides Comprising 2'-MOE Nucleosides Complementary to Human APP in Wild-Type Mice, 3 Hour Study Modified oligonucleotides described above were tested in wild-type female C57/Bl6 mice to assess the tolerability of the oligonucleotides. Wild-type female C57/Bl6 mice each received a single ICV dose of modified oligonucleotide at 700 μg. Each treatment group consisted of 4 mice. A group of 4 mice received PBS as a negative control for each experiment. Each experiment is identified in separate tables below. At 3 hours post-injection, mice were evaluated according to seven different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching; (7) regular breathing. For each of the 7 criteria, a mouse was given a sub-score of 0 if it met the criteria and 1 if it did not (the functional observational battery score or FOB). After all 7 criteria were evaluated, the scores were summed for each mouse and averaged within each treatment group. The results are presented in the tables below.

TABLE 99

Tolerability scores in mice

| Compound No. | 3 hr. FOB |
|---|---|
| PBS | 0.00 |
| 1397631 | 0.00 |
| 1397656 | 0.00 |
| 1397706 | 1.25 |
| 1397713 | 0.25 |
| 1397765 | 1.25 |
| 1397786 | 2.00 |
| 1398125 | 2.50 |
| 1398133 | 1.00 |
| 1398371 | 0.75 |
| 1398406 | 0.00 |
| 1398429 | 0.00 |
| 1398539 | 0.00 |
| 1398550 | 0.00 |
| 1398686 | 0.00 |
| 1398760 | 1.00 |
| 1398830 | 1.00 |
| 1398955 | 1.00 |
| 1399026 | 0.25 |
| 1399365 | 0.00 |
| 1399380 | 0.00 |

TABLE 100

Tolerability scores in mice

| Compound No. | 3 hr. FOB |
|---|---|
| PBS | 0.00 |
| 1397883 | 0.00 |
| 1398916 | 0.25 |
| 1399000 | 0.00 |
| 1399033 | 0.00 |
| 1399473 | 0.00 |
| 1399500 | 0.25 |
| 1399511 | 1.00 |
| 1532149 | 0.00 |
| 1532150 | 0.00 |
| 1532152 | 0.00 |
| 1539237 | 0.00 |
| 1539238 | 0.25 |
| 1539239 | 0.00 |
| 1539240 | 0.00 |
| 1539241 | 0.00 |
| 1539242 | 0.00 |
| 1539243 | 0.50 |
| 1539244 | 0.00 |
| 1539245 | 0.00 |
| 1539246 | 0.00 |

TABLE 101

Tolerability scores in mice

| Compound No. | 3 hr. FOB |
|---|---|
| PBS | 0.00 |
| 1397772 | 0.25 |
| 1398227 | 2.75 |
| 1539865 | 0.75 |
| 1539866 | 0.00 |
| 1539867 | 2.75 |
| 1539868 | 0.00 |
| 1539869 | 0.00 |
| 1539870 | 1.25 |

Example 16: Tolerability of Modified Oligonucleotides Complementary to Human APP in Rats, 3-Hour Study Modified oligonucleotides described above were tested in rats to assess the tolerability of the oligonucleotides. Sprague Dawley rats each received a single intrathecal (IT) dose of oligonucleotide at doses indicated in the tables below. Modified oligonucleotides were administered at a dose of 3 mg. Each treatment group consisted of 4 rats. A group of 4 rats received PBS as a negative control. Each experiment is identified in separate tables below. At 3 hours post-injection, movement in 7 different parts of the body were evaluated for each rat. The 7 body parts are (1) the rat's tail; (2) the rat's posterior posture; (3) the rat's hind limbs; (4) the rat's hind paws; (5) the rat's forepaws; (6) the rat's anterior posture; (7) the rat's head. For each of the 7 different body parts, each rat was given a sub-score of 0 if the body part was moving or 1 if the body part was paralyzed (the functional observational battery score or FOB). After each of the 7 body parts were evaluated, the sub-scores were summed for each rat and then averaged for each group. For example, if a rat's tail, head, and all other evaluated body parts were moving 3 hours after the 3 mg IT dose, it would receive a summed score of 0. If another rat was not moving its tail 3 hours after the 3 mg IT dose but all other evaluated body parts were moving, it would receive a score of 1. Results aye presented as the average score for each treatment group.

TABLE 102

Tolerability scores in rats

| Compound No. | Dose (mg) | 3 hr. FOB |
|---|---|---|
| PBS | 0 | 0.00 |
| 1353686 | 3 | 0.00 |
| 1353884 | 3 | 0.00 |
| 1398227 | 3 | 0.00 |
| 1398456 | 3 | 0.00 |
| 1399033 | 3 | 0.00 |
| 1478908 | 3 | 0.00 |
| 1532149 | 3 | 0.00 |
| 1532150 | 3 | 0.00 |
| 1532152 | 3 | 0.25 |
| 1539237 | 3 | 0.00 |
| 1539238 | 3 | 0.25 |

TABLE 103

Tolerability scores in rats

| Compound No. | Dose (mg) | 3 hr. FOB |
|---|---|---|
| PBS | 0 | 0.00 |
| 1539239 | 3 | 0.00 |
| 1539240 | 3 | 0.00 |
| 1539241 | 3 | 0.25 |
| 1539242 | 3 | 0.00 |
| 1539243 | 3 | 0.50 |
| 1539244 | 3 | 0.00 |
| 1539245 | 3 | 0.25 |
| 1539246 | 3 | 0.00 |
| 1539865 | 3 | 0.50 |
| 1539866 | 3 | 1.50 |
| 1539867 | 3 | 0.00 |

TABLE 104

Tolerability scores in rats

| Compound No. | Dose (mg) | 3 hr. FOB |
|---|---|---|
| PBS | 0 | 0.00 |
| 1539868 | 3 | 2.50 |
| 1539869 | 3 | 2.75 |
| 1539870 | 3 | 0.25 |

TABLE 105

Tolerability scores in rats

| Compound No. | Dose (mg) | 3 hr. FOB |
|---|---|---|
| PBS | 0 | 0.00 |
| 1353677 | 3 | 1.75 |
| 1354035 | 3 | 0.75 |
| 1398005 | 3 | 0.50 |
| 1398089 | 3 | 1.75 |
| 1398269 | 3 | 0.75 |

Example 17: Tolerability of Modified Oligonucleotides Complementary to Human APP in Wild-Type Mice, 3 Hour Study Modified oligonucleotides described above were tested in wild-type female C57/Bl6 mice to assess the tolerability of the oligonucleotides. Wild-type female C57/Bl6 mice each received a single ICV dose of modified oligonucleotide at 700 µg. Each treatment group consisted of 4 mice. A group of 4 mice received PBS as a negative control for each experiment. Each experiment is identified in separate tables below. At 3 hours post-injection, mice were evaluated according to seven different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching; (7) regular breathing. For each of the 7 criteria, a mouse was given a sub-score of 0 if it met the criteria and 1 if it did not (the functional observational battery score or FOB). After all 7 criteria were evaluated, the scores were summed for each mouse and averaged within each treatment group. The results are presented in the tables below.

TABLE 106

Tolerability scores in mice

| Compound No. | 3 hr. FOB |
|---|---|
| PBS | 0.00 |
| 1353677 | 1.00 |
| 1353913 | 0.00 |
| 1354035 | 0.00 |
| 1398005 | 0.50 |
| 1398089 | 2.00 |
| 1398269 | 1.25 |
| 1398456 | 3.25 |

Example 18: Activity of Modified Oligonucleotides Complementary to Human APP in Tc1 Transgenic Mice, Multiple Dose The aneuploid mouse line (Tc1), expressing human APP, previously described in O'Doherty A., et al., *An Aneuploid Mouse Strain Carrying Human Chromosome 21 with Down Syndrome Phenotypes*, Science 2005, 309(5743): 2033-2037, was used to test activity of modified oligonucleotides described above.

Treatment

Tc1 transgenic mice were divided into groups of 3 mice each. Each mouse received a single ICV bolus of 30 µg, 100 µg, 300 µg or 700 µg of modified oligonucleotide. A group of 3 mice received PBS as a negative control.

RNA Analysis

Two weeks post treatment, mice were sacrificed, and RNA was extracted from cortical brain tissue, hippocampus, and spinal cord for quantitative real time RTPCR analysis to measure amount of APP RNA using human primer probe set RTS35571 (described herein above). Results are presented as percent human APP RNA relative to PBS control, normalized to mouse cyclophilin A.

TABLE 107

Dose-dependent reduction of human APP RNA in Tc1 transgenic mice

| | | Spinal Cord | | Cortex | | Hippocampus | |
|---|---|---|---|---|---|---|---|
| Compound ID | Dose (µg) | APP RNA (% control) | ED50 (µg) | APP RNA (% control) | ED50 (µg) | APP RNA (% control) | ED50 (µg) |
| PBS | 0 | 100 | | 100 | | 100 | |
| 1332212 | 30 | 85 | 162 | 74 | 87 | 68 | 75 |
| | 100 | 59 | | 45 | | 39 | |
| | 300 | 36 | | 23 | | 31 | |
| | 700 | 20 | | 16 | | 21 | |
| 1353931 | 30 | 51 | 659 | 76 | 131 | 98 | 298 |
| | 100 | 54 | | 59 | | 85 | |
| | 300 | 59 | | 22 | | 22 | |
| | 700 | 34 | | 31 | | 51 | |
| 1398456 | 30 | 81 | 168 | 83 | 124 | 86 | 302 |
| | 100 | 50 | | 45 | | 70 | |
| | 300 | 40 | | 36 | | 47 | |
| | 700 | 34 | | 22 | | 37 | |

Example 19: Activity of Modified Oligonucleotides Complementary to Human APP in YAC-APP Transgenic Mice, Multiple Dose YAC-APP transgenic mice, described herein above, were used to test activity of modified oligonucleotides described above.

Treatment

YAC-APP transgenic mice were divided into groups of 3 mice each. Each mouse received a single ICV bolus of 30 µg, 100 µg, 300 µg or 700 µg of modified oligonucleotide. A group of 3 mice received PBS as a negative control.

RNA Analysis

Two weeks post treatment, mice were sacrificed, and RNA was extracted from cortical brain tissue, hippocampus, and spinal cord for quantitative real time RTPCR analysis to measure amount of APP RNA using human primer probe set RTS35571 (described herein above). Results are presented as percent human APP RNA relative to PBS control, normalized to mouse cyclophilin A. N.D. means that a value was not determined.

TABLE 108

Dose-dependent reduction of human APP RNA in YAC-APP transgenic mice

| Compound ID | Dose (µg) | Spinal Cord APP RNA (% control) | ED50 (µg) | Cortex APP RNA (% control) | ED50 (µg) | Hippocampus APP RNA (% control) | ED50 (µg) |
|---|---|---|---|---|---|---|---|
| PBS | 0 | 100 | | 100 | | 100 | |
| 1353686 | 30 | 49 | 28 | 78 | 217 | 79 | 231 |
| | 100 | 35 | | 62 | | 63 | |
| | 300 | 22 | | 33 | | 45 | |
| | 700 | 18 | | 16 | | 34 | |
| 1399033 | 30 | 66 | 105 | 82 | 223 | 84 | 282 |
| | 100 | 49 | | 65 | | 70 | |
| | 300 | 37 | | 43 | | 46 | |
| | 700 | 29 | | 29 | | 35 | |
| 1539865 | 30 | 85 | 165 | 91 | 211 | 107 | 331 |
| | 100 | 54 | | 72 | | 85 | |
| | 300 | 40 | | 38 | | 42 | |
| | 700 | 25 | | 21 | | 37 | |
| 1539868 | 30 | 49 | 246 | 79 | 115 | 84 | 94 |
| | 100 | 46 | | 51 | | 41 | |
| | 300 | 18 | | 14 | | 20 | |
| | 700 | 14 | | 12 | | 22 | |
| 1539869 | 30 | 84 | 148 | 91 | 222 | 104 | 271 |
| | 100 | 55 | | 74 | | 73 | |
| | 300 | 33 | | 39 | | 44 | |
| | 700 | 27 | | 22 | | 29 | |

TABLE 109

Dose-dependent reduction of human APP RNA in YAC-APP transgenic mice

| Compound ID | Dose (µg) | Spinal Cord APP RNA (% control) | ED50 (µg) | Cortex APP RNA (% control) | ED50 (µg) | Hippocampus APP RNA (% control) | ED50 (µg) |
|---|---|---|---|---|---|---|---|
| PBS | 0 | 100 | | 100 | | 100 | |
| 1354035 | 30 | 72 | 98 | 101 | 147 | 89 | 219 |
| | 100 | 49 | | 44 | | 41 | |
| | 300 | 40 | | 31 | | 35 | |
| | 700 | 44 | | 29 | | 53 | |
| 1398269 | 30 | 84 | N.D. | 105 | 437 | 99 | 323 |
| | 100 | 53 | | 90 | | 72 | |
| | 300 | 51 | | 62 | | 48 | |
| | 700 | 44 | | 34 | | 37 | |
| 1539867 | 30 | 63 | 117 | 95 | 140 | 75 | 91 |
| | 100 | 50 | | 49 | | 42 | |
| | 300 | 30 | | 30 | | 26 | |
| | 700 | 25 | | 22 | | 25 | |

TABLE 110

Dose-dependent reduction of human APP RNA in YAC-APP transgenic mice

| Compound ID | Dose (µg) | Spinal Cord APP RNA (% control) | ED50 (µg) | Cortex APP RNA (% control) | ED50 (µg) | Hippocampus APP RNA (% control) | ED50 (µg) |
|---|---|---|---|---|---|---|---|
| PBS | 0 | 100 | — | 100 | — | 100 | — |
| 1353677 | 30 | 78 | 115 | 71 | 88 | 68 | 70 |
| | 100 | 42 | | 42 | | 35 | |

TABLE 110-continued

Dose-dependent reduction of human APP RNA in YAC-APP transgenic mice

| Compound ID | Dose (μg) | Spinal Cord | | Cortex | | Hippocampus | |
|---|---|---|---|---|---|---|---|
| | | APP RNA (% control) | ED50 (μg) | APP RNA (% control) | ED50 (μg) | APP RNA (% control) | ED50 (μg) |
| | 300 | 35 | | 32 | | 32 | |
| | 700 | 29 | | 20 | | 27 | |
| 1353886 | 30 | 52‡ | 210 | 84‡ | 296 | 74‡ | 457 |
| | 100 | 65 | | 72 | | 70 | |
| | 300 | 37 | | 44 | | 47 | |
| | 700 | 28 | | 28 | | 32 | |
| 1353931 | 30 | 53‡ | 119 | 52‡ | 150 | 56‡ | 147 |
| | 100 | 51 | | 55 | | 52 | |
| | 300 | 32 | | 41 | | 39 | |
| | 700 | 24 | | 22 | | 29 | |

‡Indicates that fewer than 3 animals were available

Example 20: Design of Modified Oligonucleotides Complementary to Human APP Nucleic Acid Modified oligonucleotides complementary to a human APP nucleic acid were designed, as described in the table below. "Start site" indicates the 5'-most nucleoside to which the modified oligonucleotide is complementary in the target nucleic acid sequence. "Stop site" indicates the 3'-most nucleoside to which the modified oligonucleotide is complementary in the target nucleic acid sequence. Each modified oligonucleotide listed in the tables below is 100% complementary to SEQ ID NO: 1 (described herein above) and to SEQ ID NO: 2 (described herein above).

The modified oligonucleotides in the table below are 3-10-3 cEt gapmers. The gapmers are 16 nucleosides in length. The sugar motif of the gapmers is (from 5' to 3'): kkkddddddddddkkk; wherein each "d" represents a 2'-β-D-deoxyribosyl sugar moiety, and each "k" represents a cEt sugar moiety. The internucleoside linkage motif of the gapmers is described in the table below, wherein each "s" represents a phosphorothioate internucleoside linkage, each "o" represents a phosphodiester internucleoside linkage, and each "z" represents a mesyl phosphoramidate internucleoside linkage. Each cytosine residue is a 5-methyl cytosine.

TABLE 111

3-10-3 cEt gapmers with mixed PO, PS, and mesyl phosphoramidate internucleoside linkages complementary to human APP

| Compound No. | Sequence (5' to 3') | Internucleoside Linkage Motif (5' to 3') | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|---|
| 1555471 | ATACTTGTCAACGGCA | soozzsssssssos | 1153 | 1168 | 191552 | 191567 | 2557 |
| 1555472 | ATACTTGTCAACGGCA | soozzzsssssssos | 1153 | 1168 | 191552 | 191567 | 2557 |
| 1555473 | ATACTTGTCAACGGCA | soozzzzssssssos | 1153 | 1168 | 191552 | 191567 | 2557 |
| 1555474 | ATACTTGTCAACGGCA | soozzzzzsssssos | 1153 | 1168 | 191552 | 191567 | 2557 |
| 1555475 | ATACTTGTCAACGGCA | zoozzzzzssssssoz | 1153 | 1168 | 191552 | 191567 | 2557 |
| 1555476 | ATACTTGTCAACGGCA | soosssssszzsos | 1153 | 1168 | 191552 | 191567 | 2557 |
| 1555477 | ATACTTGTCAACGGCA | soosssssszzos | 1153 | 1168 | 191552 | 191567 | 2557 |
| 1555478 | ATACTTGTCAACGGCA | soossssssssszzs | 1153 | 1168 | 191552 | 191567 | 2557 |

The modified oligonucleotides in the table below are 6-10-4 MOE gapmers. The gapmers are 20 nucleosides in length. The sugar motif of the gapmers is (from 5' to 3'): eeeeeedddddddddddeeee; wherein each "d" represents a 2'-β-D-deoxyribosyl sugar moiety, and "e" represents a 2'-β-D-MOE sugar moiety. The internucleoside linkage motif of the gapmers is described in the table below, wherein each "s" represents a phosphorothioate internucleoside linkage, each "o" represents a phosphodiester internucleoside linkage, and each "z" represents a mesyl phosphoramidate internucleoside linkage. Each cytosine residue is a 5-methyl cytosine.

TABLE 112

6-10-4 MOE gapmers with mixed PO, PS, and mesyl phosphoramidate internucleoside linkages complementary to human APP

| Compound No. | Sequence (5' to 3') | Internucleoside Linkage Motif (5' to 3') | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|---|
| 1555479 | GATCTGAATCCCACTTCCCA | sooooozzsssssssssoss | 181 | 200 | 61944 | 61963 | 2528 |
| 1555480 | GATCTGAATCCCACTTCCCA | sooooozzzssssssssoss | 181 | 200 | 61944 | 61963 | 2528 |
| 1555481 | GATCTGAATCCCACTTCCCA | sooooozzzzsssssssoss | 181 | 200 | 61944 | 61963 | 2528 |
| 1555482 | GATCTGAATCCCACTTCCCA | sooooozzzzzssssssoss | 181 | 200 | 61944 | 61963 | 2528 |
| 1555483 | GATCTGAATCCCACTTCCCA | zooooozzzzssssssozz | 181 | 200 | 61944 | 61963 | 2528 |
| 1555484 | GATCTGAATCCCACTTCCCA | sooooosssssssszzsoss | 181 | 200 | 61944 | 61963 | 2528 |
| 1555485 | GATCTGAATCCCACTTCCCA | sooooosssssssszzoss | 181 | 200 | 61944 | 61963 | 2528 |
| 1555486 | GATCTGAATCCCACTTCCCA | sooooossssssssszzss | 181 | 200 | 61944 | 61963 | 2528 |

The modified oligonucleotides in the table below are 5-10-5 MOE gapmers. The gapmers are 20 nucleosides in length, wherein the sugar motif for the gapmers is (from 5' to 3'): eeeeedddddddddddeeeee; wherein each "d" represents a 2'-β-D-deoxyribosyl sugar moiety, and each "e" represents a 2'-MOE sugar moiety. The internucleoside linkage motif of the gapmers is described in the table below, wherein each "s" represents a phosphorothioate internucleoside linkage, each "o" represents a phosphodiester internucleoside linkage, and each "z" represents a mesyl phosphoramidate internucleoside linkage. Each cytosine residue is a 5-methyl cytosine.

TABLE 113

5-10-5 MOE gapmers with mixed PO, PS, and mesyl phosphoramidate internucleoside linkages complementary to human APP

| Compound No. | Sequence (5' to 3') | Internucleoside Linkage Motif (5' to 3') | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|---|
| 1555487 | GGCATCACTTACAAACTCAC | soooszzssssssssoooss | 393 | 412 | 120656 | 120675 | 3033 |
| 1555488 | GGCATCACTTACAAACTCAC | soooszzzsssssssoooss | 393 | 412 | 120656 | 120675 | 3033 |
| 1555489 | GGCATCACTTACAAACTCAC | soooszzzzssssssoooss | 393 | 412 | 120656 | 120675 | 3033 |
| 1555490 | GGCATCACTTACAAACTCAC | soooszzzzzsssssoooss | 393 | 412 | 120656 | 120675 | 3033 |
| 1555491 | GGCATCACTTACAAACTCAC | zoooszzzzssssssoozz | 393 | 412 | 120656 | 120675 | 3033 |
| 1555492 | GGCATCACTTACAAACTCAC | sooossssssssszzsooss | 393 | 412 | 120656 | 120675 | 3033 |
| 1555493 | GGCATCACTTACAAACTCAC | sooossssssssszzooss | 393 | 412 | 120656 | 120675 | 3033 |
| 1555494 | GGCATCACTTACAAACTCAC | sooossssssssssszzoss | 393 | 412 | 120656 | 120675 | 3033 |

Example 21: Tolerability of Modified Oligonucleotides Comprising cEt Nucleosides Complementary to Human APP in Wild-Type Mice, 3 Hour Study Modified oligonucleotides described above were tested in wild-type female C57/Bl6 mice to assess the tolerability of the oligonucleotides. Wild-type female C57/Bl6 mice each received a single ICV dose of modified oligonucleotide at 540 μg. Each treatment group consisted of 4 mice. A group of 4 mice received PBS as a negative control for each experiment. Each experiment is identified in separate tables below. At 3 hours post-injection, mice were evaluated according to seven different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching; (7) regular breathing. For each of the 7 criteria, a mouse was given a sub-score of 0 if it met the criteria and 1 if it did not (the functional observational battery score or FOB). After all 7 criteria were evaluated, the scores were summed for each mouse and averaged within each treatment group. The results are presented in the tables below.

TABLE 114

Tolerability scores in mice

| Compound No. | 3 hr. FOB |
|---|---|
| PBS | 0.00 |
| 1333926 | 4.50 |
| 1555471 | 1.00 |
| 1555472 | 1.50 |
| 1555473 | 2.00 |
| 1555474 | 2.00 |
| 1555475 | 2.00 |
| 1555476 | 1.50 |
| 1555477 | 2.75 |
| 1555478 | 2.00 |

Example 22: Tolerability of Modified Oligonucleotides Comprising 2'-MOE Nucleosides Complementary to Human APP in Wild-Type Mice, 3 Hour Study Modified oligonucleotides described above were tested in wild-type female C57/Bl6 mice to assess the tolerability of the oligonucleotides. Wild-type female C57/Bl6 mice each received a single ICV dose of modified oligonucleotide at 700 μg. Each treatment group consisted of 3-4 mice (the n for each study is indicated in the tables below). A group of 3-4 mice received PBS as a negative control for each experiment. Each experiment is identified in separate tables below. At 3 hours post-injection, mice were evaluated according to seven different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching; (7) regular breathing. For each of the 7 criteria, a mouse was given a sub-score of 0 if it met the criteria and 1 if it did not (the functional observational battery score or FOB). After all 7 criteria were evaluated, the scores were summed for each mouse and averaged within each treatment group. The results are presented in the tables below.

TABLE 115

Tolerability scores in mice, n = 3

| Compound No. | 3 hr. FOB |
|---|---|
| PBS | 0.00 |
| 1478904 | 0.00 |
| 1478919 | 0.00 |
| 1555479 | 0.00 |
| 1555480 | 0.00 |
| 1555481 | 0.00 |
| 1555482 | 0.00 |
| 1555483 | 0.00 |
| 1555484 | 0.00 |
| 1555485 | 0.00 |
| 1555486 | 0.00 |
| 1555487 | 0.00 |
| 1555488 | 0.00 |
| 1555489 | 0.00 |
| 1555490 | 0.00 |
| 1555491 | 0.00 |
| 1555492 | 0.67 |
| 1555493 | 0.00 |
| 1555494 | 0.33 |

Example 23: Tolerability of Modified Oligonucleotides Complementary to Human APP in Rats, 3 Hour Study Modified oligonucleotides described above were tested in rats to assess the tolerability of the oligonucleotides. Sprague Dawley rats each received a single intrathecal (IT) dose of oligonucleotide at doses indicated in the tables below. Compounds comprising MOE nucleosides were administered at a dose of 3 mg and compounds comprising cEt nucleosides were administered at a dose of 2.4 mg. Each treatment group consisted of 3-4 rats (the n for each study is indicated in the tables below). A group of 3-4 rats received PBS as a negative control. Each experiment is identified in separate tables below. At 3 hours post-injection, movement in 7 different parts of the body were evaluated for each rat. The 7 body parts are (1) the rat's tail; (2) the rat's posterior posture; (3) the rat's hind limbs; (4) the rat's hind paws; (5) the rat's forepaws; (6) the rat's anterior posture; (7) the rat's head. For each of the 7 different body parts, each rat was given a sub-score of 0 if the body part was moving or 1 if the body part was paralyzed (the functional observational battery score or FOB). After each of the 7 body parts were evaluated, the sub-scores were summed for each rat and then averaged for each group. For example, if a rat's tail, head, and all other evaluated body parts were moving 3 hours after the IT dose, it would receive a summed score of 0. If another rat was not moving its tail 3 hours after the IT dose but all other evaluated body parts were moving, it would receive a score of 1. Results are presented as the average score for each treatment group.

TABLE 116

Tolerability scores in rats, n = 4

| Compound No. | Dose (mg) | 3 hr. FOB |
|---|---|---|
| PBS | 0 | 0.00 |
| 1333926 | 2.4 | 3.00‡ |
| 1555471 | 2.4 | 1.00 |

TABLE 116-continued

Tolerability scores in rats, n = 4

| Compound No. | Dose (mg) | 3 hr. FOB |
|---|---|---|
| 1555472 | 2.4 | 1.00 |
| 1555473 | 2.4 | 1.25 |
| 1555474 | 2.4 | 1.00‡ |
| 1555475 | 2.4 | 1.25 |
| 1555476 | 2.4 | 0.33‡ |
| 1555477 | 2.4 | 1.00‡ |
| 1555478 | 2.4 | 1.50 |

‡Indicates fewer than 4 samples available

TABLE 117

Tolerability scores in rats, n = 3

| Compound No. | Dose (mg) | 3 hr. FOB |
|---|---|---|
| PBS | 0 | 0.00 |
| 1478904 | 3 | 0.00 |
| 1478919 | 3 | 0.67 |
| 1555479 | 3 | 0.00 |
| 1555480 | 3 | 2.00 |
| 1555481 | 3 | 1.00 |
| 1555482 | 3 | 0.33 |
| 1555483 | 3 | 0.00 |
| 1555484 | 3 | 0.00 |
| 1555485 | 3 | 0.67 |
| 1555486 | 3 | 2.33 |
| 1555487 | 3 | 0.67 |
| 1555488 | 3 | 0.00 |
| 1555489 | 3 | 0.67 |
| 1555490 | 3 | 0.00 |
| 1555491 | 3 | 0.00 |
| 1555492 | 3 | 0.00 |
| 1555493 | 3 | 0.00 |
| 1555494 | 3 | 0.33 |

Example 24: Activity of Modified Oligonucleotides Complementary to Human APP in YAC-APP Transgenic Mice, Single Dose YAC-APP transgenic mice, described herein above, were used to test activity of modified oligonucleotides described above.

Treatment

YAC-APP transgenic mice were divided into groups of 2-3 mice each (the n for each study is indicated in the tables below). Each mouse received a single ICV bolus of 300 μg of modified oligonucleotide. A group of 3-4 mice received PBS as a negative control.

RNA Analysis

Two weeks post treatment, mice were sacrificed, and RNA was extracted from cortical brain tissue and spinal cord for quantitative real time RTPCR analysis to measure amount of APP RNA using human primer probe set RTS35571 (described herein above). Results are presented as percent human APP RNA relative to PBS control, normalized to mouse cyclophilin A (% control). The values marked by the symbol "†" indicate that the modified oligonucleotide is complementary to the amplicon region of the primer probe set. In such cases, human primer probe set HS.PT.56a.38768352 (Integrated DNA Technologies, Inc.) was used to further assess the activity of the modified oligonucleotides.

TABLE 118

Reduction of human APP RNA in YAC-APP transgenic mice, n = 3

| | APP RNA (% control) RTS35571 | | APP RNA (% control) HS.PT.56a.38768352 | |
|---|---|---|---|---|
| Compound No. | SPINAL CORD | CORTEX | SPINAL CORD | CORTEX |
| PBS | 100 | 100 | 100 | 100 |
| 1333926 | 31 | 42 | 30 | 38 |
| 1555471 | 26 | 40 | 25 | 36 |
| 1555472 | 31 | 37 | 31 | 33 |
| 1555473 | 26‡ | 43‡ | 25‡ | 37‡ |
| 1555474 | 32 | 39 | 31 | 35 |
| 1555475 | 31 | 50 | 30 | 45 |
| 1555476 | 33 | 44 | 32 | 40 |
| 1555477 | 27 | 32 | 28 | 28 |
| 1555478 | 23 | 36 | 24 | 31 |

‡Indicates fewer than 3 samples available

TABLE 119

Reduction of human APP RNA in YAC-APP transgenic mice, n = 2

| | APP RNA (% control) RTS35571 | | APP RNA (% control) HS.PT.56a.38768352 | |
|---|---|---|---|---|
| Compound No. | SPINAL CORD | CORTEX | SPINAL CORD | CORTEX |
| PBS | 100 | 100 | 100 | 100 |
| 1478904 | 44 | 46 | 45 | 47 |
| 1478919 | 26† | 44† | 34 | 56 |
| 1555479 | 52 | 71 | 51 | 72 |
| 1555480 | 61 | 73 | 56 | 71 |
| 1555481 | 64 | 95 | 60 | 92 |
| 1555482 | 71 | 82 | 64 | 82 |
| 1555483 | 80 | 85 | 76 | 81 |
| 1555484 | 50 | 63 | 53 | 66 |
| 1555485 | 45 | 64 | 43 | 64 |
| 1555486 | 51‡ | 51‡ | 49‡ | 49‡ |
| 1555487 | 34‡† | 38‡† | 38‡ | 48‡ |
| 1555488 | 34† | 39† | 37 | 46 |
| 1555489 | 39† | 63† | 45 | 75 |
| 1555490 | 41‡† | 77‡† | 43‡ | 86‡ |
| 1555491 | 50† | 54† | 51 | 61 |
| 1555492 | 43† | 53† | 50 | 65 |
| 1555493 | 34† | 40† | 43 | 51 |
| 1555494 | 27† | 40† | 37 | 51 |

‡Indicates fewer than 2 samples available

Example 25: Design of RNAi Compounds with Antisense RNAi Oligonucleotides Complementary to a Human APP Nucleic Acid RNAi compounds comprising antisense RNAi oligonucleotides complementary to a human APP nucleic acid and sense RNAi oligonucleotides complementary to the antisense RNAi oligonucleotides were designed as follows.

The RNAi compounds in the tables below consist of an antisense RNAi oligonucleotide and a sense RNAi oligonucleotide. Each antisense RNAi oligonucleotide is 23 nucleosides in length; has a sugar motif (from 5' to 3') of: efyyyyyyyyyyyfyfyyyyyyy, wherein each "e" represents a 2'-MOE sugar, each "y" represents a 2'-O-methylribosyl sugar moiety, and each "f" represents a 2'-fluororibosyl sugar moiety; and has an internucleoside linkage motif (from 5' to 3') of: ssooooooooooooooooooooss, wherein each "o" represents a phosphodiester internucleoside linkage, and each "s" represents a phosphorothioate internucleoside linkage. Each antisense RNAi oligonucleotide contains a 5'-vinylphosphonate ("vP"). Each sense RNAi oligonucleotide is 21 nucleosides in length; has a sugar motif (from 5' to 3') of: yyyyyyfyfffyyyyyyyyy, wherein each "y" represents a 2'-O-methylribosyl sugar moiety, and each "f" represents a 2'-fhrororibosyl sugar moiety; and has an internucleoside linkage motif (from 5' to 3') of: ssooo[C16muP] ooooooooooooss, wherein each "o" represents a phosphodiester internucleoside linkage, each "s" represents a phosphorothioate internucleoside linkage, and each "[C16muP]" represents a modified phosphoramidate internucleoside linkage, as shown below:

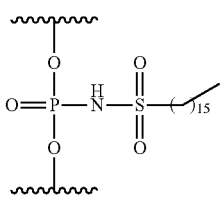

Each antisense RNAi oligonucleotide is complementary to the target nucleic acid (APP), and each sense RNAi oligonucleotide is complementary to the first of the 21 nucleosides of the antisense RNAi oligonucleotide (from 5' to 3') wherein the last two 3'-nucleosides of the antisense RNAi oligonucleotides are unpaired overhanging nucleosides.

"Start site" indicates the 5'-most nucleoside to which the antisense RNAi oligonucleotide is complementary in the human gene sequence. "Stop site" indicates the 3'-most nucleoside to which the antisense RNAi oligonucleotide is complementary in the human gene sequence. Each modified antisense RNAi oligonucleotide listed in the tables below is complementary to SEQ ID NO: 1 (described herein above). Non-complementary nucleobases are specified in the Antisense Sequence column in _underlined, bold, italicized font_.

Example 26: Activity of RNAi Compounds on Human APP in YAC-APP Transgenic Mice, Single Dose YAC-APP transgenic mice, described herein above, were used to test activity of double-stranded RNAi compounds described above.

Treatment

YAC-APP transgenic mice were divided into groups of 2 mice each. Each mouse received a single ICV bolus of 150 µg of double-stranded RNAi. Compound No. 1332212, a modified oligonucleotide benchmark described herein above, was administered at a dose of 300 µg. A group of 3 mice received PBS as a negative control.

RNA Analysis

Two weeks post treatment, mice were sacrificed, and RNA was extracted from cortical brain tissue and spinal cord for quantitative real time RTPCR analysis to measure amount of APP RNA using human primer probe set RTS35571 (described herein above). Results are presented as percent human APP RNA relative to PBS control, normalized to mouse cyclophilin A (% control). The values marked by the symbol "f" indicate that the modified oligonucleotide is complementary to the amplicon region of the primer probe set. In such cases, human primer probe set HS.PT.56a.38768352 (Integrated DNA Technologies, Inc.) was used to further assess the activity of the modified oligonucleotides.

TABLE 121

Reduction of human APP RNA in YAC-APP transgenic mice, n = 2

| Compound No. | Dose (µg) | APP RNA (% control) RTS35571 | | APP RNA (% control) HS.PT.56a.38768352 | |
|---|---|---|---|---|---|
| | | SPINAL CORD | CORTEX | SPINAL CORD | CORTEX |
| PBS | 0 | 100 | 100 | 100 | 100 |
| 1332212 | 300 | 40† | 36† | 50 | 42 |
| 1581405 | 150 | 14 | 27 | 15 | 26 |

TABLE 120

RNAi compounds targeting human APP SEQ ID No: 1

| Compound Number | Antisense oligo ID | Antisense Sequence (5' to 3') | SEQ ID NO | SEQ ID NO: 1 Antisense Start Site | SEQ ID NO: 1 Antisense Stop Site | Sense oligo ID | Sense Sequence (5' to 3') | SEQ ID NO |
|---|---|---|---|---|---|---|---|---|
| 1581405 | 1551732 | _T_GAACUUGUAGGUUGGAUUUUCG | 3058 | 2305 | 2326 | 1579196 | AAAAUCCAACCUACAAGUUCA | 3064 |
| 1581406 | 1551735 | TAAUUUAUUUAUGUAAUACAGUG | 3059 | 3179 | 3201 | 1551736 | CUGUAUUACAUAAAUAAAUUA | 3065 |
| 1581407 | 1551737 | _T_AAGAAACAAACGUGUGUAUCCU | 3060 | 2927 | 2948 | 1551741 | GAUACACACGUUUGUUUCUUA | 3066 |
| 1581408 | 1551739 | _T_GAGACUGAUUCAUGCGCUCAUA | 3061 | 1646 | 1667 | 1551740 | UGAGCGCAUGAAUCAGUCUCA | 3067 |
| 1581409 | 1551742 | _T_UCUGAAAUACUUAAAAAUGUUU | 3062 | 2822 | 2843 | 1551743 | ACAUUUUUAAGUAUUUCAGAA | 3068 |
| 1581410 | 1551744 | _T_GGGCAUCACUUACAAACUCACC | 3063 | 392 | 413 | 1551745 | UGAGUUUGUAAGUGAUGCCCA | 3069 |

TABLE 121-continued

Reduction of human APP RNA in YAC-APP transgenic mice, n = 2

| Compound No. | Dose (µg) | APP RNA (% control) RTS35571 SPINAL CORD | APP RNA (% control) RTS35571 CORTEX | APP RNA (% control) HS.PT.56a.38768352 SPINAL CORD | APP RNA (% control) HS.PT.56a.38768352 CORTEX |
|---|---|---|---|---|---|
| 1581406 | 150 | 17 | 41 | 19 | 41 |
| 1581407 | 150 | 27 | 49 | 27 | 50 |
| 1581408 | 150 | 43 | 64 | 41 | 63 |
| 1581409 | 150 | 49 | 41 | 49 | 41 |
| 1581410 | 150 | 43 | 68 | 46 | 65 |

Example 27: Activity of Modified Oligonucleotides on Human APP RNA In Vitro, Single Dose Modified oligonucleotides complementary to human APP nucleic acid (described herein above) were tested for their single dose effects on human APP RNA in vitro. Comparator Compound No. 1369632, described herein above and in WO/2005/042777 was also tested.

Cultured SH-SY5Y cells at a density of 20,000 cells per well were treated with modified oligonucleotide at a concentration of 4000 nM using electroporation. After a treatment period of approximately 24 hours, total RNA was isolated from the cells and human APP RNA levels were measured by quantitative real-time RTPCR. Human APP RNA levels were measured by probe set RTS35572 (described herein above). Human APP RNA levels were normalized to total RNA content, as measured by RIBOGREEN®. Reduction of human APP RNA is presented in the tables below as percent APP RNA relative to the amount in untreated control cells (% UTC).

TABLE 122

Reduction of human APP RNA in SH-SY5Y cells

| Compound Number | APP (% UTC) |
|---|---|
| 1398227 | 19 |
| 1398456 | 16 |
| 1369632 | 85 |

Example 28: Tolerability of Modified Oligonucleotides Complementary to Human APP in Wild-Type Mice, 3 Hour Study Modified oligonucleotides (described herein above) were tested in wild-type female C57/Bl6 mice to assess the tolerability of the oligonucleotides. Comparator Compound Nos. 156352, 1369361, and 1369362 (described herein above) were also tested. Wild-type female C57/Bl6 mice each received a single ICV dose of modified oligonucleotide at 700 µg. Each treatment group consisted of 2-4 mice (the n for each study is indicated in the tables below). A group of 3-4 mice received PBS as a negative control for each experiment. Each experiment is identified in separate tables below. At 3 hours post-injection, mice were evaluated according to seven different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching; (7) regular breathing. For each of the 7 criteria, a mouse was given a subscore of 0 if it met the criteria and 1 if it did not (the functional observational battery score or FOB). After all 7 criteria were evaluated, the scores were summed for each mouse and averaged within each treatment group. The results are presented in the tables below.

Also tested in this assay are Compound Nos. 828428 and 828565, which are described in WO 2020/160163. Compound No. 828428 has a nucleobase sequence (from 5' to 3'): CTTCCTTGGTATCAATGC (SEQ ID NO: 3072). Compound No. 828565 has a nucleobase sequence (from 5' to 3'): GATACTTGTCAACGGCAT (SEQ ID NO: 3073). The sugar motif for both Compound No. 828428 and Compound No. 828565 is (from 5' to 3'): eeeeedddddddddkkeee; wherein each "d" represents a 2'-β-D-deoxyribosyl sugar moiety, each "k" represents a cEt sugar moiety and each "e" represents a 2'-MOE sugar moiety. The internucleoside linkage motif for both Compound No. 828428 and Compound No. 828565 is (from 5' to 3'): sooosssssssssooss; wherein each "s" represents a phosphorothioate internucleoside linkage, and each "o" represents a phosphodiester internucleoside linkage. Each cytosine residue in both Compound No. 828428 and Compound No. 828565 is a 5-methyl cytosine.

TABLE 123

Tolerability scores in mice; n = 3

| Compound No. | 3 hr. FOB |
|---|---|
| PBS | 0.00 |
| 156352 | 6.00 |

TABLE 124

Tolerability scores in mice; n = 2

| Compound No. | 3 hr. FOB |
|---|---|
| PBS | 0.00 |
| 1369631 | 6.00 |
| 1369632 | 2.50 |

TABLE 125

Tolerability scores in mice; n = 4

| Compound No. | 3 hr. FOB |
|---|---|
| PBS | 0.00 |
| 828428 | 5.75 |
| 828565 | 5.25 |

Example 29: Tolerability of RNAi Compounds and Modified Oligonucleotides that Target Human APP in Rats, 3-Hour Study RNAi compounds and modified oligonucleotides described herein above were tested in rats to assess the tolerability of the oligonucleotides.

Additionally, Compound No. 1581404 was tested as a comparator compound. Compound No. 1581404 consists of the antisense RNAi oligonucleotide Compound No. 1551732 (described herein above) and the sense RNAi oligonucleotide, Compound No. 1551733. The antisense RNAi oligonucleotide is complementary to the target nucleic acid (APP), and the sense RNAi oligonucleotide is complementary to the first of the 21 nucleosides of the antisense RNAi oligonucleotide (from 5' to 3') wherein the last two 3'-nucleosides of the antisense RNAi oligonucleotide are not paired with the sense RNAi oligonucleotide (are overhanging nucleosides).

The sense RNAi oligonucleotide is described in the table below. The sense RNAi oligonucleotide is 21 nucleosides in length. In the table below, a subscript "y" represents a 2'-O-methylribosyl sugar, a subscript "f" represents a 2'-fluororibosyl sugar, a subscript "o" represents a phosphodiester internucleoside linkage, and a subscript "s" represents a phosphorothioate internucleoside linkage. A subscript "[16C2r]" represents a 2'-O-hexadecyl modified nucleoside as shown below:

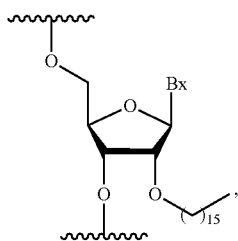

wherein Bx is a heterocyclic base moiety

TABLE 126

Design of sense strand modified oligonucleotides targeted to human APP, SEQ ID NO: 2

| Sense Strand Compound No. | Chemistry Notation (5' to 3') | SEQ ID NO. |
|---|---|---|
| 1551733 | $A_{ys}A_{ys}A_{yo}A_{yo}U_{yo}C_{[16C2r]o}C_{fo}A_{yo}A_{fo}C_{fo}C_{fo}U_{yo}A_{yo}C_{yo}A_{yo}A_{yo}G_{yo}U_{yo}U_{ys}C_{ys}A_{y}$ | 3064 |

Sprague Dawley rats each received a single intrathecal (IT) dose of 1.5 mg of RNAi compound. Each treatment group consisted of 3 rats. A group of 3 rats received PBS as a negative control. At 3 hours post-injection, movement in 7 different parts of the body were evaluated for each rat. The 7 body parts are (1) the rat's tail; (2) the rat's posterior posture; (3) the rat's hind limbs; (4) the rat's hind paws; (5) the rat's forepaws; (6) the rat's anterior posture; (7) the rat's head. For each of the 7 different body parts, each rat was given a sub-score of 0 if the body part was moving or 1 if the body part was paralyzed (the functional observational battery score or FOB). After each of the 7 body parts were evaluated, the sub-scores were summed for each rat and then averaged for each group. For example, if a rat's tail, head, and all other evaluated body parts were moving 3 hours after the IT dose, it would receive a summed score of 0. If another rat was not moving its tail 3 hours after the IT dose but all other evaluated body parts were moving, it would receive a score of 1. Results are presented as the average score for each treatment group.

TABLE 127

Tolerability scores in rats

| Compound No. | 3 hr. FOB |
|---|---|
| PBS | 0.00 |
| 1581404 | 0.67 |
| 1581405 | 0.00 |
| 1581406 | 1.00 |
| 1581407 | 0.00 |
| 1581408 | 0.33 |
| 1581409 | 0.00 |
| 1581410 | 0.00 |

Example 30: Tolerability of RNAi Compounds and Modified Oligonucleotides Complementary to Human APP in Rats, Long-Term Assessment Selected modified oligonucleotide and RNAi compounds described above were tested in Sprague Dawley rats to assess long-term tolerability. Sprague Dawley rats each received a single intrathecal (IT) delivered dose of 1.5 mg RNAi compound or PBS. Each treatment group consisted of 3 rats. A group of 3 rats received PBS as a negative control. Beginning 2 weeks post-treatment, the animals were assessed periodically, and a functional observational battery score was calculated for each animal as follows: Each rat was evaluated for movement in 7 different parts of the body. The 7 body parts are (1) the rat's tail; (2) the rat's posterior posture; (3) the rat's hind limbs; (4) the rat's hind paws; (5) the rat's forepaws; (6) the rat's anterior posture; (7) the rat's head. For each of the 7 different body parts, each rat was given a sub-score of 0 if the body part was moving or 1 if the body part was paralyzed (the functional observational battery score or FOB). After each of the 7 body parts were evaluated, the sub-scores were summed for each rat. For example, if a rat's tail, head, and all other evaluated body parts were moving, it would receive a summed score of 0. If another rat was not moving its tail, but all other evaluated body parts were moving, it would receive a score of 1. Results are presented as greatest FOB score for each animal during an assessment period greater than four weeks.

TABLE 128

Long-term tolerability in rats at 1.5 mg dose

| Compound Number | FOB Individual rats |
|---|---|
| PBS | 0, 0, 0 |
| 1581404 | 0, 3, 0 |
| 1581405 | 1, 0, 0 |
| 1581406 | 0, 0, 0 |
| 1581407 | 0, 0, 0 |
| 1581408 | 0, 0, 0 |
| 1581409 | 0, 0, 0 |
| 1581410 | 2, 0, 2 |

Example 31: Tolerability of Modified Oligonucleotides Complementary to Human APP in Rats, 3-Hour Study Modified oligonucleotides described above were tested in rats to assess the tolerability of the oligonucleotides. Sprague Dawley rats each received a single intrathecal (IT) dose of 3 mg of modified oligonucleotide. Modified oligonucleotides were administered at a dose of 3 mg. Each treatment group consisted of 3-4 rats. A group of 4 rats received PBS as a negative control. Each experiment is identified in separate tables below. At 3 hours post-injection, movement in 7 different parts of the body were evaluated for each rat. The 7 body parts are (1) the rat's tail; (2) the rat's posterior posture; (3) the rat's hind limbs; (4) the rat's hind paws; (5) the rat's forepaws; (6) the rat's anterior posture; (7) the rat's head. For each of the 7 different body parts, each rat was given a sub-score of 0 if the body part was moving or 1 if the body part was paralyzed (the functional observational battery score or FOB). After each of the 7 body parts were evaluated, the sub-scores were summed for each rat and then averaged for each group. For example, if a rat's tail, head, and all other evaluated body parts were moving 3 hours after the 3 mg IT dose, it would receive a summed score of 0. If another rat was not moving its tail 3 hours after the 3 mg IT dose but all other evaluated body parts were moving, it would receive a score of 1. Results are presented as the average score for each treatment group.

TABLE 129

Tolerability scores in rats

| Compound No. | Dose (mg) | 3 hr. FOB |
|---|---|---|
| PBS | 0 | 0 |
| 1353686 | 3 | 0.00 |
| 1353884 | 3 | 0.00 |
| 1353931 | 3 | 1.33 |
| 1354035 | 3 | 0.50 |
| 1398227 | 3 | 0.25 |
| 1398456 | 3 | 2.50 |

SEQUENCE LISTING (3073 sequences)

SEQ ID NO: 1 - DNA, 3467 bp, Homo sapien
cagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagca

SEQ ID NO: 2 - DNA, 296000 bp, Homo sapien
gtactgtaaaaagacacagacaagccagaacacatttagagaatggccaaggtgtggaaggaaccagaaaccatgccattatgcaactgttgaaggaagtgcctgttttaccttgtgaagagaagactctagaggaagaagtagcatgaaaaccgctggcaaatttgtaaagatctgaagtgtggaaaagaattattctgcttggtcactggggatacaaggatatctgagtgggagtttaaaggcgggggatgtgagctttaaatgggataagaacattctagtaaccagaaatgcccaaagatagaatgcacagtctggagagccagtgaatatctcacaaatggagacacttgaaactaggatggggatgctgttgtaggaattccagcagacaagtggttgttggttccttccccaactttgtagggttataactagggatgttcctgcgttttctgcttggaggatctgcaagacacctcagggcaggaaatggcattaaatgcagaacagagctagtggctgaaaagcaaaaagccatcaggatctctgagtagtgaaggaaccagagaacatgcaggcaatgtccatcattctgacgcaatcagcagcataatcatcttcccccaggaacatcttgaccagggaatgtgtcagtgtggtgaatttcaacagtggaaagagaaactgctaaatctaagaactttaatttttatagattatgatctcatctctacaattttgaatttcatgctcaataaaagttccttactctctttttttttttttgagacggagtctcgctctgtcgcccaggctggagtgcagtggcgcgatctcggctcacttcaagctcagcctcccgggttcacgccattctcctgcctcagcctccccagtagctgggactacaggcgcccgccacgacgcccggctaattttttgtatttttagtagagacggggtttcaccgtgttagccaggatggtgttgatctcctgacctcgtgatccgcccgcctcagcctcccaaagaaaagtccctcactcttaaagttgcctcctccttcccagggctggcttcatgggcatgcaaccctggagagtctcacaggccctgcggtgggaggagccccatgcttggtttaacgctctgccattgccatcttaaaattcttaatttaattttttttcttttttttgaggtggagtctcgctctgtcgcccaggctggagtgcaatggcacaatcttggctcactgcaacctccgcctcccaggttcaagcgattctcctgcctcagcctctggagtagctgggattacaggcaggagtaaccacgctcggctaatttttgcatttttagtagagatgggggtttcaccatgttggccaggctggtctagaactcctgacctcaggtgatctgcccacctgggcctcctaaagtgctgggattacaggcatgagccaccaggcccggccttaaaattcttaataatgtaacaaagggtctcacgtttgcattttgcagtggactctgcaagatttgtagctttggaccacgtttctctttgcattcagataccttcttttttgccttatttgctcatgcagacccggaacaaatacggaattgcggtgggtaaatgtggtgcagaaagtgaacaactgggtttgtcctgtcactttaggcttttccctgctgtcccagcttcatgtcacttacttgctattagatttgggagttcattagcttcattttcctgatgtataaataggaataatagtaacagcctctttggcttttgtaggaagtaaatgacatgaagcgtataaacaaatactgcatgacaataaatatttgtccttatttgttgaggacatccaaaggacattcaggggcaaaagtaatccaagagtcaagactgaatgcctagtgcgggaaaagacacacaagacaacatttaggggagctggtacagaaatgacttcccaggaaggaagtctgtaccccgctggctgagccatccttcccgggcctaggcacccttgtcagcgcaatgagcaagggagagaaggcaggctgcagtgcagccctcagaagggccagagcactccctggcttcagtccttcgctccaagccctgtgtggagtgggctgtggcttggtaactaaatgctacttcaggtcaagagcaggggatatatctgggcagttctagagcattctaaactatctggacactaactggacagtggacggtttgtgtttaatccaggagaaagtggcatggcagaaggttcatttctataattcaggacagacacaatgaagaacaagggcagcgtttgaggtcagaagtcctcatttacgggggtcgaatacgaatgatctctcctaatttttccttcttccccaactcagatggatgttacatccctgcttaacaacaaaaaaagaccccccgccccgcaaaatccacactgaccaccccctttaacaaaacaaaaccaaaaacaaacaaaaatataagaaagaaacaaaacccaagcccagaaccctgctttcaagaagaagtaaatgggttggccgcttctttgccaggtcctgcgccttgctcctttggttcgttctaaagatagaaattccaggttgctcgtgcctgcttttgacgttgggggttaaaaaatgaggttttgctgtctcaacaagcaaagaaaatcctatttcctttaagcttcactcgttctcattctcttccagaaacgcctgccccacctctccaaaccgagagaaaaaacgaaatgcggataaaaacgcaccctagcagcagtcctttatacgacacccccgggaggcctgcggggtcggatgattcaagctcacggggacgagcaggagcgctctcgacttttctagagcctcagcgtcctaggactcacctttccctgatcctgcaccgtccctctcctggccccagactctccctcccactgttcacgaagcccaggtgggccgtcggccggggagcggagggggcgcgtggggtgcaggcggcgccaagggcgcgtgcacctgtgggcgcggggcgcgagggcccctcccggcgcgagcgggcgcagttccccggcggcgccgctaggggtctctctcgggtgccgagcggggtgggccggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtgggtgccgcgcctcggaaggcggggggaggctgcacggtggggacgcgataccccccaagaccttaacccaagtctttaatgcagagaagccgggggtccgtcaatgggacccctctcctctccgcccccgcttgcggacgtccagcgcatccccgctttcggcccagccctgccccagggagtcgcgctccggcccgctgagagggagcgggcgaggcgctggtctccctggttccgcgccagcccggggcgagaagggtagggggcgaccctgagcccagaccccgacttagtccctgccttggaagcgggggtcgggggaggcgagagacattcagacaggggggaagggggaaggagcacgtggggaaaaccgaaaacgcagcgtccctaaagccagtccttcgctcttgaatcgttgccctttcctttctcttgggccctggggaggaggaggaggagtcgggacagcccaggaagctaggagcccctcgcttttccctgcgttctccgcctcgtttcaccttcctctctcacccccatcccccttccttgctccaacctcttttcgcggctgctggcggcggcagcctgggtgcgaccctagcccgagccggcgtcggggtcgcgcaccgccttccacaggcaaactttgtgcatgtccgcgtctcccttttgtgtaacttgcgagaaatgggaggggtcggagacccatagccaccccgcgccttccccaagtctggacgtcccgggagttcgctcgcaccctaagctctgtctgagaggcagaaggtccgcgggaacaaaagccgcgacaccccgccctcgccgtgggccgagccgcgttagtctcagtgcgccaccgaggctcccgcccggctcccttcccggggctgcgcgtccgcctgggagggggcagagacgctgccggggcttctggcggagcctcggggcccctctgcttcccaccctcggatcacctccgaggcttaattctgtgctgggctgtaaagtccttggcggggaggaaataaggcggagagtgggatgtgcgtctggaaagggcagtggcggatggtggggaggcacgggctctgtcctgtgcatccaaggaggcgtttgtctgattaaggcgcggcctcttccctggcagctctggggactctggtttagttcccctgggggcacaggatgctggggagggtccgaagggtcttttttttagggtgcagataaaaggatcgaattgagtgaagattaagacggagaagatggcgcctctgcagtgcagcaaagaaaagctgtgtggaggctgcagcctagtgaaatccacccaccactaggtgtataacaagtcttccccattcatccaactctcgaacattcagctaacgcctgtgcacaatgactgtttttctttacatctgaagatgcttagaagttgtttgcatgacagttgggccagaggaggctgtatttcacttcggacttcggttgggttcctgtttggcatcttaacatttgcaaccttccttacccgtttttcccctcttttcccccagcctcctagtaattttccaaaagaaaaaaagcaatttccgggcagatgttttcctgtaattccactgaggctgtacagactatcacaccattagttttttagtttctaatttgcaaggtcattgaacttttttctcttctgatttttacccacaagtggctcaggaatcaccttagggctagttaagacaggttgttttaagagttaaagaatttcgttttccatgttttaaaaaaatgcacttaactaagagaattctgatttctctcatgacttacttacatttatttgtagaattattccagttttcccgaatggtcttactacagattaaaaaccatacatttaaggaattaaaagcatatgataaccgtatttttgaagcttttgtcaaaacttaaatatgtaactttgttgagcaatatttctttctgtataaaaagaggaagcatgtaggcagattcgaatttagtttttggtctgtttaattgcattaatatgctctttctgccatcttttgggaccttttcagtagctattgttaactcctttaaagggtggaggtgagattcacattatgccattttgcgaagtgttggtagaagggtaggtaattcagtctactgaggtttgagggtggtttatctggttctctctgtgtccactgaaaagatgtaattacgagttgactgtcttttatagagcttagaaaataggtctgctgcaggtggctgtagaaaagaaatgaataagggcaatgataatggggccttggctatcgggggaaacatggttattatctgggttgatgattttggctggtatgttgatagaggtgtgagtttaacaaaccctaatctatatgatgtttcactaccctaatatttatttatttatttatttttaaatctagcttcctcttaagttttatttccctctgttgagggtttaacctagtcacaatcatcttacctttgtggtagtgctaatttatagtttatggaaacctgctgctactgactagtacctcgctaaaggtagaagccgacacacagaatagtaaagctcaggtttgatggtgatctgtaaggagtcacggttcttgctaatcgatgagaaaccatgataactggcagactgcagaagcttttctcttgtcaccggaaccagcagaggctcctgaacgacatttgcaaggctattagtactgcggagaagttactagatggaataatactggtcctgactgaggaaatgaaaaggaacatgcaagttcacgaggttaaatgaggaatggctgattcaaaaaaattaaaaagaaataacgtgatcaacaatattggtttgaaggaatgggagaggttgtctttatgttaagtcttgttgctagaggatctctattttatgttactgttttttgcatactagagtcttctacagatatttgtatgaatgttgtcagtcattctggaaataagcatagctattacttgcatttcacgtggccactaaactatcagtgagaagtgcattaaattcagtagaaatgtacattgtttctgcaaattgtattaccttgagaatcttacaaagcatctttcattaatacatttcttttaaaatctctatcaattacaaatgtaaagataaacctgtacagatgcattttaaatttaaagcttccagaatgtaaggtttagttcgactgcatacctcattacctccccttccctcctccctccccttactcccaggaagtttgcagggtaaataaaacatgcacatgataataaaacaaagtggaatgtactaaaataccaaaaggaaaatacagattaggtatactgagtaaatatgttacagagaaaacttcctgtatttaaaaagtaaggaacaatgggatgagatcatagataatcctggagcatttcctggtagtaaatttccagccaggtttatatcccaggtctggggattggaggttaagtttctgcatatacaatatttgtttacattcctctctgcctctaccagacagacagacagacacacacacacacacacacacacaccctctgtctctttctctctctttctctctctctctctctctctctctctctctctcacttgagtgacagatgctggtgcagggtattctcaacaggagtagggaatttgaaataaggagttgagaggtcaaaggtaaggggctgaatgcaggaccagagagcttcagtagcatcttgatgggcagagtatgagatgaacagtggcaacgaggaggatagggaaaaatcacattttctgtttgtgttttgtttttgtctggtggttttcaacctctctctgtttcacttgactatgcttgattatgaaatcttttttttttctttttttaatttaaagatctcaactggctttgttgtgattctacattcaggcaacactattctgtaaaatagtataaatgttccgatgagttgaacagaggagattggctttgtagacagaaaagggctgaagaaaacagaaataaaaaaatcttttccttttcatagtgagagctcagatgcaaatgtatggagtggggatggatgggaaatgccgtcttttgcaaacccttggaaacgctgtcaccctgtgggtctcacagccagtgtacagataacaccctcatctgtacacagaagacagaaggtggcaggggaaggaatgagcacaccccagaatgagtagcaagtttaatcaataaaatatgtatttctttttttattgttgtataagaagaaaagcagacagaactcaaaccctgaagctgattttgcaagtgaaaagcttagtaaagggggaaatgttatgtaactattttttcagtttagtgtggatggcttaagaaataatcattactgtgaggacactagtatttttcttggaaaaaaaagtttggcaaattttcctctttagattaatcttggttatagattattattatgcttgagtggtacctcttcagaagtagaaatctggcaaaaactggagtacaatgattgctctaggaataaattcacatatttaaatttaaaagcctggatatgtgcatcaattaatagctttatgaaacagggatgcttagtagattagctagctgagtattcagagagggccacagaagtctcaggttcacatgtattaaatctgctgaaatagaaacctaagagatcattttatttaggtttattttgtgtggctacatgttgaagaaacatgcaatagagatttagcttgaaccttgcgagactcacagtatcttacgaaagaagatagttaaaatggggaagatgagaggtttttaaaaatgtcacctctgtagaacgaaccagagttgttctcaatttataatgttgaatttgatgccaggcgtgatgttaggccaataacactgagtcattgagtgtttctcaggtatgtagagaaggcagcattgcacactaatcaggagagtttagaccagggcaggaatgcatgggcataaattctgtctttgtttcttttgagctagtgaccatgggcaagtttctgtgcctcagttttttcctttgtaaaatgggatgagtacttctagttattgaggatcgaattaatatctttgttaaatgcttgaaacagtgtgtgagttaatatatatgtaacctgatggcatagcataagcactgtgtgttagttgctgctatgtatggtgatgatgttgatgtacaatgggtatatgtaagtttcctgcatagttgaaagttaaaaatctagatgatgtttcacttattgacaaattacttattggccaattaagactattgcaggaaattgacagattgttgtctatgagtttgatctaaatttaaaaagcacatggtatctcagatacaatttttagaatacatgttataaaatttcatttattaaatatgtattgtgtatttcaattggttttttgaaaaatgaaaataattcatgctcattgaaaaatttaaaacagtacagaaatgtgcaaaaagcataagcattttttacacaaatgggaaatacctagtttttttttttctttttttccacataacatggatgtagaccttttttttttttttttgagacagaatctccctctgtcacccaggctggagtgcagtggcgcgatctcggctcactgcaacctccgcctcctgggttcaagcgattctcctgcctcagcctcctgagtagctgggactatgggcactcgccaccatgcccagctaatttttgtattttttaagtagagatggggtttcaccatgttggccaggctggtctcaaactcctgacctcaagtgatctgcccacctcggcctcccagagacctattttttaatgttgtacacactggcagcttgccacagatgtctaatattgagcaagtttatacactggcttgattattaactattagttggctatcagctatgtgcaaggaactgtgaacagacttggtttagttttcagtagaatctttgctagcaaaacgaataaacaggctttgccaatctgggtagaaatggaagatttcaaatgccagcaaaagaattttggtcctaatatggaagcttgaagttatgttcacccaaggacagggaaaccaaaaagcagattgcttgagaatgcggcatttctctaggaaatcagtttcaaaataaaatgaattttttgttttgttttgtttttgagacggagtctcgccctgtcgcccaagctggaatgcagtggtgcgatctcagctcactgcaatctccgcctctcaggttcaagcgattctcctgcctcagcctcccgagtagctgggattacaggcgtgtgccactatgcccagctaatttttatatttttagtagagacggggtttcactatgttggtcaggctggtctcaaactcttgacctcgtgatccgcctgcctcggcctcccaaagtgctgcgattacaggcgtgagccaccgcgcccagctgcagtaaagtgaatttgtgtaaccagccatgttatggctgttacatctttaaaactttatagtgatctgctgtttaattgaaattatatattttttttaaaaatcagcatatgttgctcaaaaataaaaggtttttagcttcaaaagcaggccaaggatatttgaaagccttgagtgtatgaaactggtgatactgtggttaaatgatgatgaacgcagggaaaaatcaagaagcagagtcccaaagaattcacatgggtttttgttaaccagctcatgtaattataattgtcctgtccaactaaagacaagaagacaagaagtgggttcacatacgaggatgtgtaatgacagaagccatatttgtgataaacatcctgattacagtagatacagtgaggagtgattaagatggttccagaagcaggagtggagggttcatgagcagggatgaggaataaataggacaaacattttggaaaagggaaaagatgaataagcctgttttgtaaattaatggatcctgatgaatgaagtgcagtgattccttaaggtcttattaatgatggaccccaaacagtgtttgaatctcttaatttccagatggttcctttttttcttcacaaagtcagaaggttttcttatgagaaatttgattcaacaagaataattgtcacttcttttgttttttggtgatttttttttttttttttttttttttttttgagactgagttttactgtgtcacccaggctggagtgcagtggcgtgtcttggcttactgcaacctctgcctcccgggttcaagcaattctcatgcctcagcctcctgaatagctgggtttacaggcatgtgccaccacgcctggctaatttttgtttttgttttttttttttttagtagagacagggtttcactacattggccagggtggtctcgaactcctgacttcaagtgatccacccacctaggcctcccaaagtgctgggataacaggtgtgagccactgcacctggccaattttttggtgattttgataggaatttttttttttgcctgatgctttttttgagagaatctaataatttgtctcttatttaataatttggctttcattagcttccagaaagccacatactgtcttcattgaaaaatgtaaggcatcctagatgatacagactgataaattacttttcagccataaaagatacttatgagaataagagatctgttgcataaagaaaagtcatttgtgttaagtgaagaaatgcattattactcttgctgctttgctaaatttcaaacattgaataactaatatattttgaccccctggagatattttacaggaagaaaaatgagaggtttaatcctactgttgagatagacttaacgtgttttagacctgcccctcatcccaagttactacaaactcatttgtttagtttttccttgtctgtgtgctcgttatttcacagtaaaattagtgaggcaacataaattttatttttaagagaaagtaaagaaaatggctttatccattaaaggtttattcatcttaaaaaaggacttgttatatctactcctactattggatgaattttcaaaagcatattgatactgtgtttggttttgtttgttttcgggacaagtcctcactctgtcacccaggctgaagtgcagtggtgtgatctgtagccgtggcctcctgggctgaagccatcttcctgccccagcctccagagtagctgggactacaggcatgtgccaccacatctgactaatttcttaaatgttttgtagagatggggtccccactatgttgcccaggctgatcttgaactcctgggctcaagcgatcctcctgcctcgaccttccaaagtgctagattacaggtgtgagctattgtgcctggccaatgttgtttttataaatatcattactcagttattttgtttataattgaattgataggctcatagaataaagatggataagcactgtttcttaactgtatttattgatttttttatctttcaaaaaaaaaatcctcatctacttcaaagattaagcctttaaaaccgatgcaaagtttttgaagtcttagcttaagtcttcagagactaacattaaaacccatcatatgaaaagtgatatgtagtagcaaatattctccatcctgatgctctcaattgcttattatggtttaacacaaatataattttgtcattacagtaaattagtttgaggatataactgaagagtacctaagaaactcccatagaaatgtgaaaatatgcagactaattattctaagaataattaatcatagatacttacatattaaattgattagcaatttaaaattaaagccaaatttctgtggaaattagcttattttcatacacaaagaaacctagattcttaggggtacaaccaagaaagggccactccttcatttcacaaatattttcgaggtccttgcccccaagagggtagacagaataaaaaggaggaaggaagtgacttggaaaaaattaagttgggtaaggaatataagagaatgctacgtagaaggatgtgtgttgtgaatgcaatagtttctgtagtattgtcaaagttctctgatcatttcagtatgtgaaggtaaacttagataactgggggaaggaactatatatttactacattgtaaaagaataattgtagacagaagatctactttgggtgattaaatgttgaaaacaagtggtgggagagagaagttagtgttgattgtgatcacacacttttctatacagtaatttgtttgatcactcatgataatgccttacattttgtatgtactaaataaatgagttctctagaaattctatgttgtggtgataaagaattacgttcagattgaagattcgaacagctgtgcaaccttctcaacatttaagaaactgcgaacaagcatagaaagaagattaaagccttttaaataagattcttttttttcagcctctttttggaacattttattgtgaaaaggtttcataaatactgtcaatacatcacgttcagtcatttgcaattgtatttcaaaaattcagttggcctgcaaaaagaaaaaatgcctcatttttgaaatatttcatccatgccctgattgattgggacactttcaatagagggtgcctagacataattttgtgtgaagaagttagtagagtttggaaagaaaatgtgtattggaattaaatttagtggcatgaaaatgaaaatttctctgtcattgtctttttttttggctccttttttggccattttacagctagtgtttagtgtgacaaggatcaaaattggccctttaaaaaaatatattgaattctattacctctgttatctaaaagaattgtatttttcaatttgaagagcttgaagccaatactactatataccattaacttgacaggaattgaaaatctaattgaggtcattatgattagccttgtatcttgctagtattttctcaatcttattttgaatgttttgtgtcaagtgttaaatcctcttataccacagaatccagaaaatttaaatgcaacagaagtaaaacgaatataaaaattctatggttgttgtggaggggcgttcttggctaacccatagggtgtttgaatgtaaaggcagcttacagaactgctgctagttgaattgtggagggtttcacttttaagagtacatttgagacaaaattgcaattttggaatcacttattcctgcttgttcagtgaaataggagaggggggaattcctgagggaagctgggagatttccaggtgatgatagagtagccatgtgagtatttggctgaaacagagtagaagccacctctgtctgttggacagaggtggccttaacactgagtatcaatcagcatggccattagagctgtccaggacaaacataatgaatgttgtggtggcagagagggtatacttaaatgaacaaaattggaggctgactttccttgtttcttggtagttcctttcttcgtatttgctatttggatatttcacttcacttttgtgagctagactcaaaggttaaatttatatcattgtgaattttctgggtcatattgtagggacacagatgggaagcatcccttcagtttattgagagtatttcttatgcgcatgtgtttttaattgtatttattgatttaataaatagccgatgagatgagaaaaaaatattagtgtcttgttgttgcagagaaaaagacattggatgcattcttagaatttattatcacatgcgaagttatttagatttacaaagcaatctgacatgttgacttcattgctcgtttgctcatttctatcagaggttgaacacaaagccaagcctaagcccgtgattcttctgtgtgcagatgagggggaaggtttaatgcagaatgtttagctgaatatttggattgtgcattccccttttatgtctctactgcaagttttctcagggcatttgtgattgacttctgtgatgttgacatttatttggagttagatgtttaaaaaattactaatttatggcctggtgcggtggcttacacctgtaatcccagcactttgggaggccaaggcgggtggatcacgaggtcaggagatccagtccatcctggctaacatggtgaaaccctgtctccactaaaaatacaacaaattaaccgggcgtggtgacaggcacctgtagtcccagctactcgggaggctgaggcaggagaatggtgtgaacctgggaggcagagcttgcagtgagccatcgtgccactgcactccagcctaggcaacagagcgagactccgtctcaaaaaaaaaaaaaatttactatcttattgtttctctcattttgaatttgtgaaattattattcattttatggacatactgcatggattctgtgtttcagttatgacaggagatctagaatctgggtggggctgtgagtaaatagaaaggtaactcagtctgtgccttgaggaattccgcagtccagtggaggaagaaagagacggagaaataattaggtacagtgtgccaaaggctataatagaggaggtacaaactcttcccagagaaggcaggcagaatttgaactaggtttcaaggatgtgtgaaggtgaactggggtggggagggcttcccagacagaaaaaacagcgagggtgtagagtttcaaagggggaagcccaggggtataataagtgaaggagacagtgtgaaattataaattttggatgcccttaatgagtttgaacttcattttcttagaaatggagtacttttaaatgttcctaaaatggggacgaggcattgatattcatggttcagttaggtttaggagcttttgtagaagtccttttcaaggtctgcttaatctcatgggccagatagtgacacctcgatgcaagggagcatgtaaatgtgctctattagctgggagcattgctatcagaaattacatttccggctctcttcttaagggtaaaggagaggtaggatattgagtggcaactggcattctgggatgtagaagaaatacagtaccataaagggatagaggaaaatgggtagacttaacgttctgaaccaaagctaagattctccgtgagcgattagagtaggcttttgggatttgcttaccttctcttatctgctagccagccacacaggaagcacatctttgtggagtgacagaggaggaggtaggaaatgctttctcatttttatggtagaaacatccaagagctgagccttcattctggctgagagaactctagatggttcagacttgcattcctgggaaggccttccagctagagtgatggaacaaagcaatgatttctgtggccctgtgtggacagcagtggcagtcagtttactctccctgttggttaactgtctttcgtttgatctagagacttcctcaaaacaattttgttgtgcttgttctttgaaagcaacagcagacaaaacaagctttgaggtttttagaaaagagcttgacactgagcacctcttttgagctagatctgtctgtcatgctgaacctgttttctgtggctgcgtagcttttcaaatctgtttatgcttgctggtgttattgaaacagaatgggaagatctatgcaaaaaggaacattgatcttaataaatttatgtcagtaagaatgggactgccattttaaaatttattttaattccttacctattttcttgttcaattattctaaaagtgattaaatgaagatacgtcacagaaagtatgctttgaaatcaagatgtggggaaaacctgtagttctgagtaggcctgatagaatcatcattgttagagtatttggaggttttgtagtagggattttgtcttcacttaaatatttagttgaaatatgttccaatagtttgacacattacagaatctgtctgaaagaaatgtctaaaatatgattcctcagaagctgctcttggttttactttctgctgttggttttactttctaacatttcattttgatcccgcagttttaagagtaatcaaaaaggccgggcacggtggctcacacctgtaatcccagcacttcgggagactgaggtgggtggatcacttgaggtcaggagttcaaggccagcctggccaacatggtgaaaccccgtctctacaaaaaatacaaaaatcagccgagcgtggtggtgcatgcctgtagtctcagttactcgggaggctgagacaggagaatcccttgaacccaggaggcggaggttgcagtgagccgagatcataccactgcattccagcctgggcaacagagccagactctgtctcaaaaaaaaagagtaatcaaaaagctacattatttaaatcttggcatgtctttaaaaaatgttaaactgtcaggaaaattatcacttctggataccaccttcagaaaaacacatgaaaatttgtgcatgtctcaaatagttgttaatttatgaaaaattagaaagagtgtttgaatgtatatttctgtcatattatattgctcatatttttaaattatactttttttcacccgtgaagcccatatagttaagtttgaaaattttaattatattagaatttgaaaattaaataaatctcctttaattcatgcataattttctaatagtcatatagtttgtattatataatttgagaaacttggttctaaaaaaattgtctgccaaagaatgtatatttctgaattctgttctgctttcatacatctgaaaatatttgagctatcataactggctatgcttcaaacccagtctgaaatgggtgacctttgctggctttggattgcagagctgggggctgttgtttgctttatctgatttaaaatagtcagtagtttattttgcaggcagttagatgtatacctttgcataaaatcattgaactgaaaaggttggcactccaagaatacgttgtgagaaaagagaacttgagtactcactctcgactcacctgaatcttattaatattttattgattaatatctgttgtatttttaagtaaataagctctctagaaactatctctgcttctttgttcatttaaaatatattaaacaaattgatacagattgcaaaaattagttgcaacgttcctagttagatatcaatgaaataaaaatggtctattcatacgagttcattttagttattcctactaatatcaaatgtgttttaaaaaatgggagattataatctttttatgaagtaagataaattattactttgtatatttaattcaaagaaaacaaaaaggccacaagtgcctgcataaaggcacatccacttaggattattgttaaggcctacagttgataattaggattcaggcatagcataaatgaagtggtatctttttttttttttttttttttgagacgaagtctcgctctgttgtccaggctggagtgcagtggcacggtctcggctcactgcaagctctgcctccctcctgggttcacgccattctcctccctcagcctcccgagtagctgggactacaggcttccgccaccactcccagctacgtttttttgtatttttggtagagacagggtttcaccatgttagccaggatggtcttgatctcctgacctcatgatccacccgtctcggcctcccaaagtgctgggattacaggcatgagccaccgcgcccagccagatatcaattatttttagacccaatgatatttgctgttgatttattgttggtgcacaaaataagaaaacaaaagcatggttttaaaacagccctttacacatttaatatggaaatggtaacctacaggtctgtattccatacagattcctgggctcattttatctgtgaattcctctgggcgtcatgcatgcccaggactgactttaaagcagaattatccagtagaggtataataggaccgttagatctaatttaaagttttcaagtagccacataaaaaaataagcaggcgaaattaattttagtctgtcactaaattcaaaatgttatttcaacagggggtcaatataaaagctatttatgaaatacattattttttcatattatgtcttcaaaatgttcacatttcacatatttattttttattttattattactatttttttgagacggagtctcactcagtcggttgcccaggctagagtgcaatctagcttgctcattgcaatcttggctcattgcaacctccacctcctgggttcaagcagttttcctgcctcagcctcctgagtagctgggattacaggcgtgtgccatcacacccagctaatttttttatttttggtagggatgagatttcaccatgttggccaggctggtcttgaactcctgacctcaagtgacttgccgctttggcctcccaaagtgccgggattacagttgtgagccaccgcacctgattacatatttcacatattttaattcagaccagctgcatgtcaagtacttagtagccacagatggctagtggttactgtattggacagtgcagctctaggagagtctcttcaacctgcagctgtctaggaagagaatcatagtttctggaacaggtagaatctataagacctcctttttaagcttctccactttacagatgaagaaagtaatatctggagatgttgagttgttcaaaatcacccacattttaaggatcaagagcccagtccctgttctctaacttctaatctctttcttcatcactttttctgcttcatgttgctgcatcccctttagttactaaggtactaacgttaggttgttgctatcagttaaatattaagccaggagctttaagacaatctggcccacttgaaggcatggcctgatttggacaaaacttgtggggtaggatgaatagagttaccaggcatatcttcaacctctctgtggactagtattatacatatatgagatgatgtagggtccagtgatcagttcatctttttctattgtgagcactgttggaataggaatggggggaccttttgggacccaggatatgtgattctgaaccctgaaatgtcagatgcccactaaaaggaaggggagagatggacctgtcattaccttacacattttattgtctgtatgggtatgtaaacatgtacagattataaggaattgcacttcatttctgggcttctggaaacacaggtattaagatttcatttacctccccttgttttggaaggcttattgtgtgtgtgcccatagttcttacccagttacacttaaagtatgatactttttgacagcttaagcctattgcattcctggcatgtaaaatagttattttcagaatgtaagcaaatgtggaaagcttactgcctgacatggagggttggagaagtgggattggtgttcttttgttgtaaactcatttttgtgaaatatttgctttacaacgtgaagcatgcatgatggatgaacttttagaattgaaagttatttttcatttcattcctgaaatatttaccagcatggatgttgactgagtgctttgaagagtttgcttagtcatataacttaggttttatgattttagatttaattaaacttaaagttttcctgtttgatcctcaggacttctcatctgtggcaaggctttactcacaaaggaaatatcaaccttgaagttaagcatgccctgtgtttctttatattctgatgaaaacgattgaagtttgccagtgctgtgtctgggacaatgcttagaggattcatggcttgtaggaatgagttaaaagtacaaggatattggctggcatggtgactgtcgcctgtagtcccaaaactttgagagtctgaggtcagaggattgcttgagctcaggagtttgagacaagcctgggcagcataaggagatcccatctctatgttttttaaaaaagtgaaaaacaacaacaacaacaaggtacaggggtatctgcgtttccttaggcagctgtcttatatacctttaaccttaaaaaaatccaccatttttaaaacagtgttttctgttgtttttcttagtaaatataaacaataggaactgaagtttagggcttaaaatttttgagagaataatttttatttcagtagcttttggggtacaagtggtttcttgttacttagttgaattacgtagtggtgaattctgagattttagtgcacttaagtagggtaccttgtacctaatgtctagtttttcttttaatccctagtcccctattaccctcctcctcgtgagtctctaaagtccaatatgtccctctgtgtgcctttgcttattcctaacttagttcccacttataagagagaacatacggtttttggttttccaattcctgaattactttacttagaataatggcctccagctctatccaagttgttgcaaaagacattattttgttccttgtaatggctgagtagtagtccctgatatatatatgccacatcttctttatcctctcattagtcagtggccacttaggttggttctgcatctttgcatttgtgaattgtggtcctgtaaacatatgtgtacaagtgtctttttcatacaatgacttcttttcctccgggtagatacccagtattaagattgctggatcaaatggtagatctacttttaactctttaggaaatctccataatgttttccatagaggtggtactagtttacattctgagagaataatttttgtaaaattatgtttaagctagatttggaattgggaaagaattacattctttataggaagcttttgaaaaatatatttaaaaatatataaaaatatgcataatcctaccacccacaaatgtctgtattattatgtcatttctaaaccatttttgagattatgctatagattacgttttagatcctacattttatttcttaacattaaatctcatactattttaagttctttgtacatgtaatgtttactgaatgggtaaatctgtttagggaaactggagctatgtagttgtggacttgtgcttttgttttgttttgttttgtttgtttgtacatttgctttttagaaatgtctattcagatccttggcccatttttttttttttttttttttttgagatggagtcttgctctgtcgcccagactggagtgcagtggcgcgatctcggctcactgcaagctccgcctcccgggttcacgccattctcccgcctcagcctcccgagtagctgggactacgggcgcccgccaccacgcccggctaattttgtttttgttttgtatttttagtagagatagggtttcaccatgttggccaggatggtcttgatctcctgacctcgtgatccccccgcctcggcctcccaaagtgctgggattacaggcgtgagccaccgtgcccagacagacatgtgcttttttatttggcatttctagcctgaacataggctggaagtagtgacttagagagggattgtttgccaaatatcaggtaatattttaattatttattatttattgtaatgctgtgaatcaggagtccctaacccctgggccatggactggtaccggtctgtggcgtgttaggagctttgctgcacagcagtaggtgagcaatgggtgagtgagtgttgctgcctgagccctgcctcttgtcacatcagcagggcattagatgctcataggagcgcaaaccctattgtgaaccgcatgtaagaaagtgagagctgcgttgcacactccttattagaatctaatgcctgatgatctgaggtggagcagtttcatcccgaaaccaaaccacaaaattgtctttcatcaaaccattccctggtgccagaaaggctggggaccactgctataaattgctgctgtcaagtagtgttacgcatggtggtctttaacataaaaaaaaaaggtaatgaacgtacaccacacagattagcaaaaataaggaaaggctgatctagtagttcaaacaagcaatcctcttatttaatggttctgtgattgctcgtgtaggcagaagcttaactgtaagttgttgcatttgacaggcaaatgtagctggagctggaatgtagatattagtgaaattgtgatttcagtttactggagccattcagtgggagcatgaagtgggttacatgattacacggatataaataaagcgtcctccttgccacttcactgctgttaaagtctctcctgatgttatgtggtgaaaaacaagtcaaaaacattaattctgtcaagtttccaaagatataagaatctttgaccagaaaagagacggtatttatcttcaaatttaacaaattgtgatgaaatgctgctgttacagaacctagtgtaaggtcgtggagtccattcagccagacacatgtaattttgattattaactgccgtttctgtggtcagtcggccagttttatatatttcacattataggtatttggagcaaagacagtgttgtttattgtttactttaaaaaaatacaatactgtaactacataatgagtaaatgttgatactgttgaaaactaataaaaacaaattcttacactatcaacatcacagaaattctaattgtaagaaaatattgatataatatggaaatccgttcatttatttggtgcattaattgaacaccaacactatgccaagcattgggatacaaccatgaaagaggccagcttcctgatctcacagagcttgtactttgttgggtggggcagagagcaaatcagtcaatctgtctgtctgtctgtctatctatctgtctatctatctgtctatctagatgtcaatcagtatactctgtgccacttggtggtcagtgctatgaagaaaaattaagccagtgaggagctggatagagacacagtctggaagggtatgaaggggatcagaatatgctacccccaaatatgccatttcagcaaagtactaatttgagctgaagacaatcgagaaatagcagacccaggacaagctttaccccctttttataaaaattttgctgtgtgaaggtatcctccttcccctctccatccctggagagaccactagaggtggcaccatcgcctgcagaaacaaaccttattgaaataacccttatcttctattagtttcccccatatatttaccttaccacacttcccctggaagccctaatcccctctcctttgtcttgtgacttctccacagtttattgctctttgttaaaatggtgtgtatgctctcaggcctaactgcttcttttgggtttttgcttttctgtggagctccctcctctcccctccctcatgtaaaaataataacattaaataaaatttgtgttttttcccctgcgaatctgtctcgtcagtttaattggcaaggcctcatgtgctgaacctaacagggtagagaaaaaaggtttttttccccttttctacaagtattaaacctggagagaacaatacagtgtaaaggctgtgaggtgggagcatgctggggtgttggaagaagcacatgagcttacaaacattccatcaatttgcattcattccaaaaattgtatgcaatttttcagtgacgattcccattgatcaatcatttataaaaactaatggtgagggtcttccatactcagtttactcccttcttggaaaagaatgtacattttaatcaagatgatttcatgaaagacattctgtactccaaacatttaaaagagcgtttagagtatacagcaattcatcttttcttctgtattttaaaatttaagacagggagaattattgtattatacttagttcagatttggtggtggttttgttttttggttccagtgaaaagaaattgcatcagtaacctggcggtcaaccgtgccatattgtttgtgatttattagtctggaaaaaataactgtatttctggcatatgtaaaaatagtttgctgagaggcctccttggttgtggcaatagtaatactaattaccaggtactgtatgtagctcattctatgaaccaggccttgttgaaaagtgctttcacttaattttttcttttcagcagcctgtgaggtacctactgttatccccagctgggagggagctggccagtggactgggtttaaactatgttttcattgtctttactcttaaccacttatcttctctgcctccagcaaaataagtcaaagagttcagccagtgtttcttcttggactaagcagtcagcctcctaagtaagcaagccttggaatgcaattgattggtaagatactaaagtaatcagtaaggccctcagttcctggctgccagcttctttcaccctctcctgcaggaagttctgaatgctgatatctctacttggtgtcttctctccccctcccaattccattatttccctttttctcaatcccaagtgaaggaagttctgagtgtggatgttggagtcattcagaccttggatctgagtcacaactctttcaatttactagaaatatgactgcaagaaaatgatgtaagcttccctaaaccaatttccacatctacaaagtatctaaatagattgcttaggagaaaaattgaattaaattgaataaagtgcaaagcacagaacatggccaggagtaggccctggatgaatgagggaaaaatggttctgatttttatttttgagcctctttgtaacatttgttggccccttcagaataatccttagagttcatatcagccacccttcatccctcctgggatgggccaggggagaggcccagttgcctgtgacactgcttcgtttcacatttcactgctttagcatctcaacatttcattgataacatttttgatgcctgaaaacagaataacttatttgtaattctacatacattttgtttgtgatcaagttgttagagtttgaaatgagcctcatttccttgggttttgtccctccccatctgaccttcctcttctcagtgaaccctgaagaaaaaacactagcaaaggaatctcaagaatgttggttcgggacacagctctctccatctactctcctgccctagtcctgcccctccttgtgttttcagcggtgaccaggcactggtgacagccttggctgcttggaccagctggaggtagctgcaaaatgcctgcctgctagctttgaaaaatctctgccaacctcattgaaataattgtttaccacatatcagaggggactgggaagtgggtaattgagagatctttttgaaggggtttgtggcttctccacttgcagaggcttcctgaaatggtgggtaatgctcatgcctcagggagaatcaatatccttctcctaaaacctgctcacacgtagctctaagtattagacatgcatttttgttaacattttatcagtgcatttttctacctgtgtcatttggaccttagattcgggagaaaatcactgtgtatctttggtggtttcaggtggctcttaaatttcattaattcacaaaatctgaattgaatggaatagtctgttttgggaggtttttttgggggggttggggagggattggatttttcagtccttccaagagacttcaggttttttttttgatgttctgattagcccggtgtgtgtaaggccctatcaggtgttcgcctgtgtgatcctatcacacccacatcctgtagctgcatccaagtgctttgaggccgacttaatggggattaacttaacagttgctctgtgggaacagatgctctttgccgcttatttctaataaattgattgagccatttaaaagattttttttttcttttaagttacatcttcttaagaaactgtagacaataaagcaaaactaaaatacttgggtctaaaattagtgtattatatttaaaacactgggcttcagactgattatatcatgctcttttactgactttctagtcagatgcttatttataaaaataaagcttatataaagggcagcattcaaatgttacaccagtcggttttagcagtttgaccttccacagtagctaaatattttttacactgagagaagaattctttaacattatatgctatcagcatgtcaagtgaattctgagcttgcatgcaacagatgagaccctaggtggaaacataaaaacataccagtgtgaaagagaaaagcaggctctctgtctttgggaaggagttctgcagggaggggtgtttataagtgtagtagatacttaggaaaattaatacaattattataaaagtcatctgggaaaaaccattaggtaagaatagccaataaaaaaccagaagcaaaatgtaaagatatagaaattaaaactgcacatcccatgcatagataggtcaatggggcaaactggaagtctagaaataaagttgtgcatatattggaaattagtgcaagataaaagtgtctttttacatcagaaaggggaaagatggattatttagttaatggtgttgggttatctgactgtacatagaaggaaggtgggtaattatttacccagtaccaatactggattacctagtattatgtacccagtacagtttgtcagcaacaaaaggcaaacttttttattccatgaagtgttcttacaaatcagtaagaaatactaaatatgaacatcttcagagaaaaatgaacatttttgaaaacttattatgaaaagaattaaacatacacaagagagaatagtgcgctgaatgctcagcaatgatcagctctcacccagtcttgttttatctgtattcccctttctcaacctgctcaattctcttttccctcactgggttattttgaaataatttcaattctataattttatgtataaatatttcagtgtggatgtctaacagaatctctattagacgtggacaaaaaaggcaaagaattttatagtacacaggaaaaaatacacagccaataaacctatgaagatatgctcaatctcatagtcgtcagggaaatgcaaagtaaaacagtgatataacattgttttttaaaaccctgatgggcaaagactaaaaaggcttgccagattggcattttcatctactgtcaattgataacagatatttctttgcttggagtacagtggcacagtctggactcactgcaacctctgcctcccaggttcaagtgattctcctgcctcagcctcccgagtacctgggattacaggtgtgagccaccacgcctggctcattttttgtatttttagtagaagcagggtttcaccatgttggccaggctggtctcgaattcctgacctcaagtgatctgcccactgcaggcatgagccgctgcatgcagctggtacagaaattttttagatcagtcatttagaattttatgtacatatcccttgatctaggaattctagaaactaattagttcatagtatattgtataaatgcgcacagatgaggatattatgagagcattatttgtatcaactaagcaagcctttaaaaaactcttatacagtagaatattatgctgatacattaaaagtgggcataaccatactgatgtatagaaatatctaaaatcataccgatataagtgaaaacattcagaatgcaggcataatcacagattaaacagtaatttatataaaaaacagaaaatttatatgtgtattatgtcagtagcagattcaagtgaatctgacaaaatctgactctgggcaatgagaacattggaatggaggagaaggtagtacatatttactttgtatattatcaccttttgtactatttgagtctttttaactgtacgcagatactttagagcaggggtccccaacacccagccatggacaggtactggtccatggcctgctaggaaccgggccacacagcaggaggtgagtggcaggcaggtgagccagtgagcattactgcctgagtgctgcttcctggcagtagattctcacaggagcacaaaacctattgtgaactaaacatgggagggatccaggttgcctggtccagtccttgtgagaatctaactaatgtctgatgatctgaggtggaagagtttcatcccaaaaccatcccatcccatccagtctcatgccatcccacccccaacaccccatggataaatggtcttccacaaaaccagtccctggtgccaaaaaggttagagatcactgccttagaggctgctccctcttggcacatcttgaatgtaggactccttggttctgccattcctggtaggtagtcagccagcttttgatagttctccccagagacttcatcccacaggcaagccatcccattccacgtaaaacatctctaatgttaggaaggcacgtattttgatgtgatatctagaatcctcccagctgttcttcagaggaacattacttttataaagttgaaaagaacgttttattgtattataaaactaggtcatttcagtgaatttcatctattttcatgggtaactgattcttatatcaaaacttgcttttgaaagtactggaagcataaattattacttcaggcccatttgctttactttgttcagcacattgaacatcaaggagcaactccctcgatctaaaatttctagcattggtgcttgtaatatcatttttcaagttgacattaatgctatctttggaattctcatggtaagtcagaagaaagcagtttagtggaactgttctttctcccactgaattgtatactgagatctgttatattttctgcattttaacccagaaagttgttcaagagaattgaccatgataagacatctgtagcttattttgtatttttttaatggaaaattgtaactgacttttaaatttaagattgagtgtagcctttcccaaaccaatagctaatgtttttataactatttagtgtaggagattataataaaatccacattgcttaagatataaaatgtttgtgcagtaataggctgtataaaaacagtaaattgagattgtatcaggaataatgtattataaaccatatatgaaaccaggtactaacttggtattctgcatagctttatcagaaaggcagagcaaatactatctcaaaatgaagtataaacaaaatgaggttcagtgagtgatgtggtttggctccatccccacctggatctcatcttgaattgtagtccccataatccccatgtgtagtgggagggaccaggtggagataactgaatcatagaggcggtttcccccatcctgttctggtaatagtgagttagttctcacgagaactgatcactttataagggacttttccccccttttgcttggcacttcttcttcctgccaccatgtgaagaaggacgtgtttgcctccccgtctaccctaattgtaaggttcctgaggcctccccagccatgctgaactgtgagtcagttcaacctgtttcttttataaattactgagtcttggatatgtcttcattagcagcgtgagatcagattaatacagggaggctacataatttgacccaagtagcaataaacaataggggtgaggttgaaatccaggcccctggtacttatggccttaagctaagtgaaataagccagacacagaaaaacaaatactgcatgatttcatttatatgtggaacctaaaacactcaaactcatggaaacaagagtagaagggtggtgttaccagggtttggatgtgggggaagtgaggcgatgttggtcaaagggtgcaaacttgcagttatgagattaatacctaatgtacagcctagtgactagttaataatagtgaattgtacacttgaaaacgtctgcgagagtaaatgttaaatattcttaccacacagaacaaaaaaagtaactctgaggtgatggatatgttaattagcttgattgtgataatcatttcacagtgtatacatatatcaaaacatcacgttgtatacattgaatatacataatttttgtcaattatacttcagtaaagctagggaagaataaaagaagtgacctaaccaggacacctatctgtagctctatggtaaagccaaaagggataataacttttgattatcaaaacttcatcatcattattattttttaagactgggtcttgctatgttacttaggctggtctcaaactcctaggctaagtgatcctcctgccttggcctcccgacatattaggattataggcatgagccatcacacccagccagttttgaaggtatctttattacatttttttgtttaaatatttaatagtaagtgtttaacttgaagcatttttttctgccttaaaattgattttcccactcattttatggatcaaaactattatcagattttaattcccactccaccacattgtttataaaagttgacaattatggaaagtaaagtaatactgaatttttctaatgcctatctttgacatggaataaagattataaaatttcttataacttgaatgagtttttaaaaattggacatctttttataaaaatctagcattgaccatttcaacataagttttacttatctctgaaatacaggtagtacctatttttattaattttcttaagtgatgctgagtgacactatttttgttttttttcactttttctttactttttttttgagacaggatctcagtctgctgccaaggctagagtgcagtggtgtggtcttagctcactgcagcctcggcttcctgggctcaagcgatgctgccacctcagcctcctgagtagctgggactacaggtttgcaccaccaggcccagcagttttaaagattttttgtagagatggggtcttgctgtgttgcccagactggtcttgaactcctggcctcaggcgagcctccgacctctatctcccaaagtgctggaattatagacatcaaccaccgtgcctggccccagtgacactgtcttaattttgaatagggaagtatctaatggtattaaaatggtctggcagagaaggggatatgaggcttggtgaaaataagcacaggatgcaccatctttgagtaagtgttagtttctgcagtgagccagcagcaacattcttagcagagcctagaaagatcgagtgagggctgtgtggtggtgcagcctcttaagtctctctggttccacaacatgctcagattggtggctttgatattttctccatccaggacgcattgtgctaagcttagggaaggtccagtggatatttaccaagcctcttatactgccccgcatgttgccatgagacagcagcgttatcaccttaaatggtgcaaatactccttgtgcataccctacccctgagatctaacatctggattctggatactgtttcctattcttccatcttgctgcatggttcccaggttatgtatatagtgtggctaggcaccacacatggccctggctccttgcagccatacagaggtgacctaactggatgtaattgggtatgtaccgggtgttggctacctgtgcaggttgagggccttccacaggtctagcaaagcaattcattgcctttctgaatttttgaatgcttcatttgtgaaacccttgatgtaataactgttgatattatttctttttgaaaactccccttactcttccctgtttcttcatttgtaaactggaaccgatagaaaagtaccaaacttagggttgttgtgaggcgtaaaagaaataatacagcccagagaacatagtatatactcagcaagtatttattaatatgactactaagccagcattggtgattgattggctcatagtgtcttctatttgccagatgttttcagaggctctgttcatgttcatacccatgtttgtaaatgacagaatgtaaatttcttaatcctctgtcttctcctttagcatcagctcttgtccccaaagtaaaagaactcagtcatccagaacccagttttgtagatctatttttcaaaattgggcagttaatagaaaattaaaagcagtctagggaaaagcctttcctttgggtttgttgctttcttttctgtcataataagactgtgcccaaactgtagggaaaaatcaagaaactgtaaaatacatcatcagggtgtttatagtaaatgtaaaacgttaagtaacatttgagttaatctgtgcttgtacaaacctcagaagcttaaataatgaaccaatgacatataatttagaaagttttcattagactctttgcgttggtatttgcaatatcagatttgcatgtcatcattattagccttcctctattttgagtgttgactaggtgccaggcgtcatgttgagaaatttatgtgcttatttaattctcacactgactccatgagatagatactccattttacagatgaggaccccacatcataaccttttggccagaattacagttagtgttagaatttaaacctatgcagtctcattccaaatcctctgtctttactcctccagaatgctccattaaatgaattgtttcttataatccggttgttttaacgttggaaaagaacttgagaacatttagcccaaccaccctatgaagtttggcagtacttcttgccattctttcaatagataatttatttgagtttaagggagagtctatgaattaacactagtaccaaaactcccatgagaaaataatgtagacagcttttgttaaaaaagcagaatttttaaaggtgttcattcagttatcttcttgcctaacaagttcctgtgttgtgatagactttgaatttgttaaatatgaattggcttcctgattctagctgttttgccagaggcctgatttagagaagggattaaaccactggtcaaccttggatggaatttgggccagcagttccttctccacagcccctgacacttggctttgtgccaagaaaatcctacaaaaggaaattgatttactctacccaagacagagttccggaggctttggttgtccattgttagcttagaagttggcgcagtgtgcgtgtgatccacgcctaaatagcacagccttgctgtgcgtggtagaagttgggttagtgttgacatgctgttgactcaccctcccgaggatggaagctctggcctgggtcaagttgtggtcactgcagttaacagtttgttgatctcagggagtattccacagttgctgatgtaattgacaatgattggagccagctcttccccagattcaaatggaccaattagaggacttgttggttctgtttatcaactatgtaagtgagtactgtgaagttggcattgtttttagtctgtatttgggtaagatgaaactctgttctcagacagtaatatctttcaaaagtacaatgttacttattgtgaccaaagtagggatgaagtttgcaaattatttggtgtaatgatttaatttggccatccatgcagtgcagttctctaccagtgtgattgttctctttgtaaaatactcttactttgccagaaaattgtttgtttgtttgtttgtttgtttgtttgtttgtttgttttgagacggagtctcgctctgttgccaggctggagtgcagtggcccgatattggctcactgcatccttcaagcaattctcctccctcagcctcctgagtagctgggactacaggtgtgtgccaccacgtccagctaatttctgtatttttaatagagacgaggtttcatcatgttggccaggatggtcttgatctcttgacctcgtgatctgcctgcctcggcctcctaaagtgctgggatacaggcgtgagccactgagccctgttgaaaattcttattaataagatgtttctcatagaatgtttcaaaaaattgtgactggtttcaaaatcagatgatttgcaagaattagccatagtataaacacatagttctcaaaccgttttctgggagtgggcccagagatctatttaacaaaaccttgagtagagtctggtgcaagttaaaattggagaaccactaatgtaaccttaccttatctgtggaccacattttgagctttggaagaaataaccctttctatccttcacaaggtaacagatgatttttttgcacaattatttgataatgagcttatatttgagattaaggtatgcacacgataatgtacattctcactctaggtctggggaccttgattctttgactcttctgtccttttctctccagttacttggttttgtgcattaacaaacttttcaatttacttatttttttttacttatttacttatttctcatcccttacgtaatgttgcatcattgttttttgtagcctctgcagttcaagatactaatcacccctttctaccacattaaaatacagactctacctaaaatcatgtatgggagtaacttgatatatacgaaagtgtaaccgtgtcacaattccccgccccaccccgccagtctacataaaactgcaaacactttattgcttaccaagaaagtagacaataatatcgaagaaagccctccttttcctcttctttgaccaacaagggagcagttcctgacaaatgtcagtttgctttttgagttccttaggtttctgtgttgtgtttgcaatggataaatattgagtaacaggtactgactgtattgtatacattgaaaactatccaccaacagaatatttgcaggaggattttgttttgttttgttttgttttgttttgttttgttttctgagacaggctatctctctgtcacccaggatggagtgccatggagtcatcatggcttactgtagccttaacctccttgtctcaagcgatcctcccgcctcagcctcctaagtagctaggactacaggagaggaacaccatgcctggctaatttttttttttttttttgtagagacagagtttcgctgtgttggccaggctagtgttgaactcctgggctcaagaaatctcccaaagtgctgggattataggcatcagccactgtgcctggcttgagaatgacattctataagtagtttcagtcccttagtttaatcccatattttgatcctataacatgtacaatatttgtgtatagtatatgatctgccaactctctaagaagattttaaaacttattatgttaaatttcagacatatacatcatccagcttcaaaaattgaccacattttgctgttcttgtttcagcacctccccctgccccattttcttttctgaagcattttaaaataattctcaggtatcatatcattttacttctgttcataggtttctgaaaggatttgatgcagaatgttattattaaaccagtatacagagagaaaggccactggatattagtacatgttttggtttcagacggtccttttaagagtatattaaatcacataaggattttctgagtacccattagaaccacaaaaaatacctatgatacccttcttactgcagtagaagatgagtttcctagggtagccctttgttgatggaacaaacatgtattttgtttcatcaggaaaatcattggaacagccatgactcagatccactaaatgaaggaacaaaaataggacctgcctcacctcctgatttttttttaaatctctaggatgagtaaccagaatatttttatgttgtgctaagtaggtttgtttgtttgttttttactctgacttatattatttgaattgtagaaatatattgtttttacttttttctttaaaattctatctggagtttctaaatgagagattgtagctcctaaaacctttcttagttttggtgtcttgctttctgttcttagcgtctgtggtcatttctaactcccagtgaggaaagagctctctggtcttgtttctttgttaaatgaaggagcaaacctccgtctcgttgatccactcccaacccacttgttttgtaacaatgaaagttatctcatacttaaaagacaacttgaaattataacacacctgtaacaaagtaaagggtatgggtttttacttaggtttaaaaaaagggcagtaacccttttcataaaaaagcaaaatttagatgggatagaacccccgtttatagaaaagattttaaaatctcatttgctctcattgaaaccttaaccttctctcaaatactggcgcacctctgaggaacttcaaatacggtttgaaaactaatggtttaaggagggccaggcgcagtggctcatgcctgtaaccccagcactttgggaggccgaggtgggcggatcacttgatgttagcctgggcaacatggccaaatgctgtctctactgaaaataggaaaaattagctgggtgtggtggcgcatgcctgtagtcccagctactcaggaggcggaggtggaggcgggaggatctcttgaacccaggaggcataggtgcagtgagcagagatggatctcttgaacccaggaggcataggtgcagtgagcagagatcgcgccactgcactccagcctgggtgacattgagactgtctcaaaaaggaagacgaatggtctaaggaaactagtttgtggtttctcagcggagaatgacattctagtttctacagatctggcaacagaagacaggcacataaactggcctgctttggagtcagggccaagacttaaatccagatttaaaaccagctttttttttttcttcttctaaaacaaccaacctgtgttttaggtccagtgtctgccttgtaagttgctcaaagctcagatacaaggaagtaatcagcacacatttttgtgataacattcctgaaaagaaaaagatgaggtggactaaggtaaatacactgctccttaaaaatccatatttttagattatttataaatcaaatgggcatggttaccaaagatgaattctagaggtgtaaaactccagtcttatacctcaaatttcagttttccttagggagcaaaacacttccatgatcttactgaggacctaaaaaagcctgtacatattttaaaaatagcactccctagataaagcctgatggatccagggtacagtagaatcatgaaattgcctgtttctttttaaaagatgtatatgattgctcggtggctgtatattgtccatcgtgtgcgtgcctgtgtggtatgttggttctttcagagaggcagtggcgtgcagagtgagaggatcacagatgtgtatgtgacaaaactatttcttttctttcttttcttttctttctttctttctttctttctttctttcttttctttcttttcttttcttttcttttcttttttcttttttgagacagagtctcactctgttgcccaggctggagtgcaatggtgtgatcttggcttactgcaacctctgcctcctgggttcaagcgattctcctgcctcagcctcctgagtagctggattacaggtgtgcaccacgatgcctggctaatttttgtatttttagtagaggcagggtttcactgtgttgttcaggctggtctcgaacttctgacctcgtgatccgcctgcctcggccacccagcgtgctgggattacaggtgtgagccaccgtgcctggctgacaaaactatttctaaaacacaagtccagatattcctaccaagggctctctggggcttcgttttgatttatatgcaaaacactcctaatgtggtgacattggggagataaagatctgggatgatgagagagaaaggcaggtaggacacatgcccttccagtaactttccagctagggcttgcatttaacctctgatggaggcctcaccatccaggcagatgtacttgcttaggaatgagtttgagataataaggctaaatgtgctgccttctgtatataatttgcatttgtcctaatgtacgactaaggaaatgaaaaatcaaagtttgagtgactaaaataaaagaggtctgtggagtaattggattgaatttgcaccaagtcaaggagaaaacttctgtattttgtatgttttgtcatggttctatgattacttgttagaaagtgatataaaattcaataacttagtttgatatgaacttggctatctttaagttatagaagtcgtgcatataatgtggctgttttcaacccccataccctttctgagtggttggagatgtcttgaatttcgaagtgagaaggtctggtgctgttacatagataatcatgttagccagctttaccttctgataagctctcaatttaagaaagtacttctaatcctggctttatctttggcttgctatcttattatgcacagagcataattgtaagaagggaataatatctcttgctgtctattcactaagaatagtgtgaggacagggctcttaaaaacatgaagagatgggcactattgtatagatatagagatttgatgaaatgttaaaatgttggatgattttaaatgacaagtggagtggtgagaagtttatttttaaccttatgtggataccttggatatttagaaacatcgaagttttaaggaagaacaaatatcttgactccaagaaaatggtcatgtgatactgtggcatctatttggtcttcctgatgtatatgtttcctgacatttagctcctaaaatccttggaatctccagtgctaagaaggtcttatatgctaatgagatgactggtggctgggtaacctaccatgtgattagagggttaggactttcagtcaccctccccaacctccaggagctgaagtttgagttgataaactaatgatcaatgatacctacataatgaagctttcttaacaaccctgaaggaccgcgttctgggaacttccagatagctgaacacatggaggttcctggagggttggatgtcaggaaagggcatggaatctcgttttctcttcagccgcacctcaccccgtgcatctcttccatctggctgttcatctgtgtgtcctttgtaatatcctttaaaataaatgggtgaatgtaagcaagtatttctcttagttctctgaaggtgctccagcaatgaatcaaaacgaagtaaggggtctggggaatggtagccagttggtcagaagcacaggctacaacctggggcttgtgattgacatctgaagttgggggagttttgtggtactgagccctcagcctgtgggatgtgtaatctccaagtacagtgtcagaatccagttgaattagaggacactcagctggcatccattattggcatgcagtattccttgtcatgagcctgggcaacatagggagacctcatctctacaaatatagctgggagtggtggtgtgcacctgtggttccagctactcaggaggctgagtgggaagatcgcttgagtccaggaggcaaacattgcttctcctccaaatgctgtactttaacatgtttggaaactcctgcaaaggaatttcaacataagcgaagtcaatgggttataaaggactgaatgccattttgtaaatgtcagaaatcaaagtcacaaccaagttaagttctagattagggccaggaagagaaatgtattatctggtcaaccatatcaaatctgtattttggtggaagagcattttcttatattggttctgattggtttgatacggacagggaactgttttctttattccagttatttgttttgttttgtttctgagacagagtctcgctctgtcgcccaggctggagtgcagtggtgcgatctcggctcactgcaacctctgcccctcaggttcaagcgattctcctgcctcagcctcccgagtagctgggattacaagcgtgctgtagtttttgtatttttagtagagatgaggtttcaccatcttggccaggctggtcttcaactcctgacctcatgatcccacccgcctcggcctcccaaagtgctgggattacaggcatgagccaccgcgcccggcctattctagttgttaatcagttaacatagccaaaagatatagaataagattgtagactgaatccatagtctaatgatttgtcttcctagtaattgtgaataattcagacattcaaaattagtctggcatcatacaaacattagactagtcctaaaatgaggatattggcaagtgtgttaataaaaattgcatatgcagtattaataggttccttacgtaggctgccgattactcaggaactgtcagatgttttgttttgttttgtctttgagagatggggcagggttttactctgctggagtgcagtggcacaatcttggctgactgcagccttgacctgctgggctcaagcgatcctccctccacagcctcctaagtagctgggactacaggcatgcaccaccatgcccagctaatttttgtatctttttttagagacggggttttgccatgttgcccaggctggtctccaactcctgagctcagggatctacccacccatgcctccctaagtgctgtgattacaggcatgagccactgtgcccagcccccagatttttaatcttctctttgacattgagtttcagaaatgaagtataaatggtgaatttttagtgtagaatatgatgcactaggaagatcacttacccgtttattcactttcttagaccatgtcaacccgattctgaatttagggttctgttgtgatggtgttctttagaagtgattttaacactcaaaatactatagtctgtaacataatttactgattttttaatttttgcaaactaagttgaagtaatcaagtatttatgagttctttgggtgagaccatctgtcaaagaattctgggcttaatggagatacatatatgttgtgaatactaaacagatatccaagtaataaagcagaaatcatatgctgtgtaacagaaatgtaaagttctgaattagttcacgagtaggagagaaacttttttttaaaggtagaggagaactaaaagtaatttcttaaaagagtgcctattttacatcttgaatattaaaagtctaattcagtgccttgggatcttgttctttttgtagattttgatttgaatgaacttcagtttgctgaaatgtctaatgggtgcaaagtacagatttaattataaggttgagctaaaatcagaatttaagcatatggcatatataataccaatttaatctttcccccttaaatttagttatttttagtgagtcccaaacaccatatttgagacatcacttttttcttttttaaagagatagggtctccctatgtgaggctggagtgcagtagctattcacaggctcgatcatagcaaactacagccttgaactcctggccccagtgagtgtaatgtctcaccatgccaaagtacttttatcttaaattgcttatttttttgtttatttttttaactgactctgtttacaaaattaaccttttatctagtgacagctagattgtatcacatttgtcatctatggacaactgatttttagttgtttaatatggtaagtttattattgtttttccttatttaagaaaacaggatctgagtgaaaaaaaaaaaaatcttaattcaactatcacgattccagtaggaagtagacagacattcatctgtatacattaggtgtcaaagtagagttttgtggtttatcattctgaagatttgagattcaagacatgactatctttcagtcatattgtgcaatagataacatataatgtttctcactgatgagaacagttggttagatctctcagatgacttgaattaggtattagttcaagtcagttgtcagtaagtttggctttatcgttcagaggagcttcttatgactggacatttctcaagtattgccgtattggtcatttggctatcaatgcttaaattatactcagtatagtataaattttcttatttcccttatttaagcatgcctccattacactgttgttgtctctaataagagtttaataatctttgttttggcttagtaaaaagagccaacaaatatatgagtgactgactgagtgtattgctctatgcgcaattgtcttaaaggaaaaacgtttatagaatcactgtgaacaataaaatggttgcatttcgctggaaaacctcggtgctcctttggtaaataatgaagtgttttgttttacgggccttttcactacttcattgacaacagacctttttttttaaattaattaattaatttatttatttatttatttattttttgaggtggcgtttcgctcttgttacctgggccggagtgcagtggtgcgatcttggctcaccgcaacctccgcctcctgggttcaagcgattctcctgcctcagcctcctgagtagctgggattacgggtgagtgccaccacgcccagctaattttatatttttagtagagaaggggtttctccatgttggtcaggctggtctcgaactcccgacctcacgtgatccacctgcctcggcctcccaaagtgctgggattacaggcgggagccactgcatctgaccaacaacatatatttatattacccagtaataggcatagtctaaggaagataatagaatttattcttagtagtgaactctttggcttttgaagcagaatttttttttctttgttcttttctgtgatagtaaggaaggaaggaagggaaggctactactaaaaatataaattgctaaatagaagtcaagtctctgggtgttgaagctcacatattggtgctgtccagacctgacgcatctagaaacaggaatttgcccttagcgtaagcttagccaaatggttgagtcatttctaagtattttaacattatagaatgccttaggaaatgtcatgaatatctaaaacaggtcttcttgaggattttattagtttcttaaaacatggaaaggaacttgattctcagtgctggtacctaaaattcaaagacattagttgtgagttgctgtgctcctcagctctaagccacagttgtcatggccaagcctgtctccttatggagagtggccttgctgtttcctgcagagcttctcttgtgcctggcttgtgcctggaagtcagcgtgtcaccacttcagagagacactatagaagcttggtgatcttcaaacaagaacttaaaacaaagaagttttctttcacagatatcttaaaacttgtagctaaataaaacgtgaataactgtgagagcctcattacagcaatttttaaaaaagcagtacatgttttgttgtatcttaaacatcacagaatggtattgtgtgtccagttttgtttgtaaaatgtaaccttcgtgtgaatgaccatctattcctttctttttggaaggttagtttgtcagctgttgtgtgatgctcaacattttatgtaatgacatttagcacaacgtttcaatataacatctcaggaaaacatttaagaaatagtgaagttctctgggtattacattaatcatattaattacctgttgcttttaatttatcaccgtatcaccctaatatcacaaggcatgtgtagtactattttgtaaagattttctaaagaccttccctctataggaaggaaaatttaattcagaaattgggctgaactctctttcacttgtgtgaaaatgggaaaattagaagtaatttgtattttttattgtgaaatcagtgtaggaacctgtgctcgtatcatggaaacaacagcactaatgtttttctcccctcgggtgtgggctttgctgcagatatccatgtcttctactttttctgttcttagttcttattcacttattgtctatacttcgtgtcactttattgaatttcacaaatgcaatttaggaatccagggatgtgataaaatttgtgcatctgcttgtcattagccatctcacgtttatatcgctaagtgaaaatttaacttagtttggaacaaaccaccatgatttagttcacctgtatagtttaaaagacctaagacctgaaatttttttttttttttgaaacggagtctcactctgtcacccaggctggaatacatggtgtgatctcagctcactgcaacctctgcctcccgggttcaagcaattctctgcttcagcctcctgagtagctgggattacaggcagctgccaccacgcatggctaatttttgtatttttagtagagacggggtttcaccatcttggccaggctggtcttgaactcctaacctcatgatccacctgcctcggcttcccaaagtgctgggattacaggcgtgagccatggtgcctgtccaagacctggaattttacactgcattgggaccttataaaattcttgacttgtacccttttggcattttctgaatgctcatgatttgcttctgaaatattttaggcctttggaaacactccttcattctaatcctctcttttcttgctctcaattcttcatgtcatgtaattattttgcctagagccaaatctgatgtgttattataatcatcatttctgcaggagcttggtaacactcctgcttttgttccctttaaggcttcttttggttttgtttattttgtttcactcagaatgatctggttaagttttgcttgatcatccatttcaaatctcttagtacatttttcaaattcagttccaagcatgttaaatgtgtcacaatggaagtggcccacggtcaaatacattttgggaaaccttggttttaaaaaagttaaactgacttcattattacggttttttttttcaaaagcctccagtatccatcttgaatgatccatttcccatatgtgttttatgacagaattctccccactcccaggtaataactgttgacattttctgaaaactgtttttgagaacactgaattagatatgaaatgaggcatttattcatacttcgaaacgaatgtcttaaacctcactgggccattttgagtatacattactagtgatatatttaataacttagtggtataagcatgcaataacaaatttcttacacaagagaagttctgtgtagaaacaaatttaatactgtggctaaagaaatgaaccaaaaaaatttaatatcttgaaatttgcttcttagctctgtttagaatcattgtgattcacggatagtaaattgtcagagtggacttcatgaaccttatatcagacattctgaaaagagctaaaattgccattaaactgcatgagttaaaatatcttagatagtttaaaaatactatgtagacttggtgagtcagatctgccacactgagcgtgtagctggggttgacgacacacgtgttgcagtgtcgttaccagtttgtctcttttagagacaacttggcaggcagacgtcttgcagataaacaaggaaagattgtctattttaaatggcataagacattctttaaaccagtgtgtcatatgtggttatatagtcagcattttctttagtgcaggaaatcctctctcagggttcctgaataaatagcaggtatctttgtagggatagctcgcaggagatttcaaatgctgtgtattcatcagttcaggctccccagatgtcttacgaacgtgctcattttagttttcttttcttttccctcttcctgctagatacaagttgagacaatatgattagctcttaaagtgcttactctccattttatgtatattactgcattttaatcctcataatatcctgtgaggtgggatgttactatgtccatttgagagataaaggaaatcaagaggtaaagttaactggctttctccaaacagctggtaattactaaatacagaattgacttttgccttttgattccaaagatcatattggtactttcatgtgtgggtcccttcagccagttcctacagtgaccctgacccagctgtaagtcccctgaggtctctagagatatagacagtgatggattagaccctgttcatagttgcagatacaagacatagagaggtttctagcaataatttttttagttatatattttcatagggcttttgatttatgtaacctattagtatatatttgttattccagtagagttaatacattattcaaagagattccagtttttaagccttttctccgtttgtctaagttgttcattatgaaatgattggctagaatttgaaagtctttacctacagagagattctgactggcttgcttggtcttggaaccctagttatgagtgcattgtcttgcttcctggtgaactttgcccagaaatagttaccacctcattttttttttttaaatgaaagctggataattaaccctcaagatttcttaattaaaagattactattataaattgacccacagggagttaatacaataaaattatttttgatcattttatatgaaataattatggggcaatcttctgtaatcttgagttgaaggggttatcttgcttaatgttaataacttttgatacaccaactaccttttaaaaattaacgttttttttttttgcttctgtggaagggaggctgtattttgtaggatttacagtttacatagttattgttttatatgatgtcagttggattaattatgttttgagtggaaactctgtttggttcaaccaatatttgaatgctaattttgttctgtgaacaaatagaaatacagagaacagtaagacatgactctttccccctaagtaaaggcttaggttggagttttcaacctgggaattactgacattttgagccaaataattgtttatgttgggtgggggagggcctacagcggaggctgcctgtacattgtaggatgtttagtaacatccctagcttctacctactagatagatgccagtagcaccacccaagtcgtgacaatcatctttgccaagaactttgaacctctacctagaaacagttcatagggctcaaaaagcaaagtggcctaggacccatgtagttaacaagcttaccctgttggagaaccactgcatagctgaacaacatgggtgagactagtgtcagggtaaaggagctcttgactggagattggccgtacacagaaaacaaagtgagtgttatggatatttggggatttaccttcattagggcacagttggttagcgttaggtgtacaccaacattattccctctttagaaacagccatgcacgtaacattttagcacatctgaagaggcacttctattctaattacctaaaattcttattatctagaattacatgctatgaacaacagcagtaaagtcagaagccagaatctatgtgatgttatctgttttgcgatcacagttgtgttcttctcttagtttatttgaacaagtttgtgaaaaaatttttgtgcttatgtaaatactctttgcttagattttttggtagaatgtaaatctttcccacacagtgcaatacccctcctgcccaagggcgagatatagattgtacagtttgttatttctgtgttttagggcttattcctctgtagacatgtcaaaaagacatccgtcgggggtaaggaatgcattagcaattcaagctgataatctgcatggtgagagtccagataattttttccccaggtcacataggcagctctgcacaagtctgttaaacatatgctagttttgaaaattaaaataagttcccatcactcaaggcaatgaaacgtagatgaattgctctgccagattgactcttagaactcctgatgtgatgtggggctagacagaatgggatgtttgctaataaatcagggaggtagtgattgttttccttctttttctcccccacccccgtcaggacaaactcacattctgtagcctggtgcactctaataatgcctgttgaccttggccatgaaagcactctagactcaccccctaaacaccgcaccgaatgtgctcatccttgaaatttacaagccttagaatcttccctacctccactcctgtttactgcctcctgttactcctggtgcttccagtcagaccgtagtcttggctgtgcagtacctttaggagccctcaaaaatgtttaatttcttttaaaatcagaaggaaaaataaagaacaagataataatcatgaatatacaataatgaatccagcctgacttagagttgtctttataccaatcaacagagccctaaaatatagcttttaatgtttttttaagagagaaagaggcccacgaaagttgtcctggggcccccgcatcctcctcatacactggtgggatgctgctcttgcttgctttggaatgtggcagcagctcccagtgacttcacacgtttattacaaattcaaggtcatttggacgctagccttgtgctacctttcatgcttcctgtccgacccatactcagcctgggcatgttttctgctctgatctttggtctgccttccttctccttctccaagtcaaaccagtcactctttcctgagagctcttcggtgtacccttgccagacctctgcattaacactccagcacctttggttagccaatttggccttatttgtgtctccaccattggattatctgtccatcaaggtcaggaatgttttcgggttaccccactgtccccaactttgaatatgttcactgcctggaaaatgtttatctgaatataaggcatcaagccagaacttgcccaaaacttaacctaggactcaaacagctttgaaatcttatctgtgtagagtgggaacggcatgtgtttgataaccatcagcatttgctgttttgcttagccatcaacaatccgtttctatctcttcctcatagtattttcagctgtatttttgtacagcagtcattcacgttaggtgttaggttacactgaaatctctgacaaccagttctgtgctactgaaggcttttagcagcaggattaaaaaaatagttgattgcacattcgaagtctcactgctcacactgtttatgtaattcttggagtccagttagatcatctgatttttaaaatgttgcctgaattacaaaggagttcaggaatgtgttatcaaagaattaggaaattaacattgaaatttattgagcaacatagctaataggttgtcttgctttttaagccttcttgttttctaggaggagcctgaagtccgtggacaagttgaactgtagctggtatttaggaattggtaaagacagaggtgtggatgctatgttttcttttctctgttaggaaattactctcctggtgccacaataaaaaatttcacaggtatctaaagtggaatttattttgtattgttccacacctttgtcaataattacattttctaccttctagtttattactgttattatttttcatgccaggtgtttcttaattgttggcataagtatttattgaatgcttatatgtgggagtgagagagtcaggccagtgctaaagagtagggaataacccctagacagtgaagtaacttttgtcttgtttgcacattaaaaaaaaaaaaagattaggaatccttgctctatatactagaaatgtttgatgttctcttttcttctcttcaaacagagaaaacttagatgaatacttataggctctactgtcaactaactgcaccctcctaatattggcgtctgcatatttttaccattgtcaatatcagattgcctctgatgttgtgtcactgaaactgatagtaacattacatccaagagtaagactgcagtgtgatttttggctcttggtcttctgttctttcggcaacaattttttataaatatagtcaagaaaatagaaataagagtcttcactgctacctccccttcagaattattttctcctagtattgtggttcctgatagcctttattcctatagaaatggcaattcgaaaaattccttctgtgaatctgagggctctacaaagggagagcttctttgatagtgctttggtgtaagttatttaagaaggacaatctacccaggcttatcaagcaaataacctggaatttaaacctggagtattctttagtgttccaagtctgcaggaaaagaagtaatcttggcttaaactaaataagttaacagaatacaatttgaacaatgaacaagaatgctgtttgaaaattatcttgggtttttatgtcaagttaatattctcactgaatttctattatgtttgtaaagcagctttctcctagaccaaaaatcctagtaataaaaccacaacagtatgagagttataagcacacagtaaaggctgatgagtaaatgttatgacactttgaaaggaaataaaccagacgatataatgtaaatatcctttgtgcttatcaaaaataagtgacttcatgttctgttcctgcaatatttctgtaaatctgctaaaaatagaaaggtaaaggtctaagatcataaatctctgatgccctttccttaaaagtaaggaattcttgtcttggattcttatataatatacttatttataatctcacttgttctgattgcaggtggcctcttactatctttacatccatgtgaatgtgtgtgctttgatgtgtacatatgagagacaagaacaaaagtaaatgtcaaatatccgaattcctgtttcagtgagctttcacggagtaaattctttttgtctacttgcctgtgatctcttctaatatgacttgcgttaatgacctttaagaaatcttttaataaaataaaaaattttattaaaatcttttaataaaaaaattttattaaaatcttctaataaaaaattttattaaaatcttcttcatacgtgttacttgaatttactcatggcaaggaccagttagtaccattttatgaaatcacaagctcatgggcttgtgataaaacatataagtgctttaaatttggcattggtaacggcaggccgactcacttgaaaaatgctctgaactgctctgcctcatgctggtgggaagtcagatggaaatgactttctagagagtttagctggcctccaagcttagtgggtactcactctccttatcccccgatagctgctctgagattttaatgcacattgaagacaatatgataacttaacctggaaaattagcattttggtaagggtctttaacttcattagtattttcataccactttggtattagaaattgtaaagatattaaagggtatggacaatgtggaatgtatgtaccagactcagcagtgtatactgactccctcactatagcccagaactggaaatcccgctaactacctctccccatcctagcctgaattgccctctccacctatgttggttttacaatggcctgacgcctgaaagctggtagaaactgtataggaaaatagggttgggataaatttctgggctgacaaaggatagaggaatatgcttctttttccccttgtccaagtatatcagcaactctaagatgcagatttatcagtatggctctactgggcatgttctagttaaatggtagacccactacctcttctggaatcttgttttccattatattcccacctgcagcttttcaaagacttattctcttctctaatggtctcttggttcttttttttgcccatgctctacgttccgagtgggtcaacattgcagtgggtcaatgagaagaaatagaggggaaaaataaaagaaccagaaagaaacctgttaagtttgcacttacttgtgcattaagcatattagcgtaagccttaaactctagaaaactcactgtagtgctgtaaagtaccactgataaagtaaaagttcatttttatgctgtgtcgttatttagtgatgaatatgatattgcataaaagatgaggatctgtaaggccaggcgcggtggctcacgaggtcaggagttcgagatcagcctgaccaacatgatgaaaccccatctctactaaaaatacaaaaattagccgggtgtggtgacgcgcgcctgtaatcccagctactcaggaggctgaggcaggagaatcgcttgaaccagggaagtggaggttgcagtgagctgagatcacgctactgcactccagcctgggcgacagagtgagactccgtctccaaaaaaaaaagatgaggatctgtgtataactgccaggtgttgtgtgaggtaccatgaataacctggcaatatcctaactgtgcaggtatgaggagtgacccccaggaatataattgcaattaaacttgcaaattatgtggggatactctatttcagggcaataaaataaattatgtctagagctcataactcttacacatatttggctaggtctatgcagcaaaacccaggtgataactgaggctttaactttgggatttgtttggtgctgactctgccacatggtgaaatttggtaggatctcagtgcgagtgtcacatgatcagtctgcttgacccaacatgccagaattccatttctcagcccactctcttctctgcatacatacctacctcccggagagggctgggcgggagcctacgtgtggcaagagccctcactgcttttgttacacagatttcaacacatatggcttgatggagtgtgattgcagtagcatgaatgtttggtgatgaaatttgcatgtcctttgctgggagaagtataattataagatttttgtattcacatagccacatgtgaggtatgagcaggaacggggtctatttaatagcattagattgctttcagatttgaaatatttccttttagaaatatattgtgtaaacaaaatatgtttaattttttttaaaaactatgcctttgtacaaattgtttatcatttgcagaggtctaaaaaatgtaggagaaaagaagctcacaaaatcaatcagatctaaagattgcaaagattgattaccatctccttaaaagcttcagtacatgtgtttacagtatcattctatttgcctctgctcagattctttccaattctaggacaacccaaagtgtatagatcataagccataactgatcctaccttacataatacattaaatataaaatatttatggccaggcatggtgaccagttctgtaatcccagcactttaggagaccaaggcaggaggaacacttgaggccaggaagttgagaccagcctcggcaacatactgagaccttgtctctacagaaaaattagccaggtatggtggtatgggcctgtactcccagctgcctaaaaaaaggcaacttgagaaagtttctaccttctgaaacaatctatgccttgattctatcacttagtattttagttattcctatcaaatacatgactgtgttaatttcttttgccacaaaaatgctgcaaagccacaaactcactccaaaatttagtggcttagaacaataaccatttattatagcccacaagctcaagggtcagctgatcccggcttagcttggctacatttgatataaaacagtagaaatttagaaattgaatatatgtagaatatctcttgtaccaaaaatgaagaggaataatagattttgatttttctttgttgtattctgtgctgggtgctaatctgtcctagctgtcagaacaagtagaagccatactggaaaatcatttatttgttactatcaaatttatttcagtgaatgccattcaaaccactctctctgaggagcccagttaccaagtcctccaccttgttagcaacatggacttaaatgcactaattctagaatgagatcttagcaaagtaccagcatttgagatttgtgcaaattgagctcttaaactgtgtgtatatgtgtgtgtgtgtgtgtgtgttcattctagcactcccactacataccatacaagtagctgtatagcaggtatatatacatgtgtatatgtacataggtaggtatatgtcaactgttgaaaaactagaaaatacacattaaataaagtaagggttgataaacattagtagttggaacattgggagatttggacttctactttgcagattcagttggctgcattagatttaaggaaagaactaactttggagaaatttgtgtttgcatttcaggagagatttcttaaagaggaaactaccagaggttagtagatattaacatctagtgatttaaatttgagaaatgcaaattagacatttaagctgtgggtttgcttcccgttttacttgctctaaaagtaatttttttaaaagccagtaacaaagacatgcaaaatagtactgccatgggggaaaaattacttgaaaataatattcaagattgaagaattaaaaaagcttgacatctagtaccaggaatgccagctggcttgttctgtcaaaaagcaagcatgtgctttggaataacactcttgagtagactctaggcgggttttgagcccttctgattatctaaatagatgtggaagtgacttatcttggtttttctgagtcaaatgagataatgagcaaaggccttagtaggtctttgatttttgcctctaaccctttttctatctgcatgttcacaaggtcaaggctgatgagatatggcaatattgagagagtcagaataggataaagatctcaaatactatatatatatttttttttcatttttttttccctttggtgactgtatgagacatgtcagtaaaactttaaagacaggccaggcgttgtggctcatgcgtataatcccagcactttgggaggccgaggcgggcagatcacttgaggtcaggagtggcaacatggcaaaaacccgtctctactaaaaaatacaaaaattagccaggcgtagtggtgcacgcctgtagtcccagctactcaggaggttaaagcacaagaatcgcttgaacccaggaggcagaggttgcggtgagccgagatcaccccgctgcactccagcctgggcgactgagcaagactctgtctcagaaaacgaaacaaaacaaaagacacacagaaaaactgtaaagacagaatgaaagagatgaactttttacatctcgctcatttcatcacatactatatagtatgtgtatggtttcatatatgttagtgtgtgtgtatgtatatatatgaagttaaaagaaaacattcaccttttaagactaaatggacattgactagattgtaaactgtttttgaggctaagagtttgtttgccatgcataaggctctattttttgtaattccacttttatattcatttatatcagtcctagcagtagatgccactcttactgggtcctgcctaaatgcatgcttcaaatgttggttattaatttcacgagtagtgaataacaaagactcctattgagggacctcttgatttcctactgggcaccagcagcaagcatgacttactggccttcttatgagtgggtaggagttttgggtcaacttgagaacatctatcctttgagtagtaaaaaagcttggtattaggttggcacaaaagtaattgcgatttttgcaccaatctaatatcaacagaggccgtgaaaaacatcaagggaggatagcttgtaattagaagccagatcaacagtgacccaaaaagaatttcaggtttccaggagtgaaatatgtagattactcctctgaaaggaattgtttttctcctattcgctttcatggcaaatcattttttaagccgaaactcaagctctgaaataattgtgtagcaaatagtggctgtgaatagatgtggcaactctccacaagggtaaatagaaaccacttgcagtttcagtcatcacattttatttttcttttttaatagcttctctatttttgctcaccacaaatacatgcacacacacacacaggggcaaagccttggaaaattgcaattttccattttaatttgagagacagcccggtcacattaacagaacccttgacggaataggttgaattcccttctctgtccctataaccccatggccttggacatatccttacctggtgccctttcctccctcttatggtccacttttgtgattctgattttaatttcagttctctgttagtgatgaaatgagcaactgcagatgttccgcttacactggaaatacttttttggcatttaaaagaaaaccctacagatgaattattcccctgaaaggggttcactcagattttctagattatgattctagaaaatagttctttacatttgacaatggagaatttaaatgttttaatatgaaaatgtaaagcactcttgtggggtatagttgaattatgcccaggttaagggaatccagtatttatgtcaggaaaccatggatgtgatagaaatagtatcgctacaaagctgggcacagtggctcatgcctgtaatcccaacattttgggaggccgaggcaggaggatcacttgaggccaggagttcgagaccagcctggccaacatggtgaaaccctgtctctactaaaaatacaaaaattatctgggcgtggtggcacaggcctgtagtcccagctacttgggaggctgaggcaggagaatagcttgaacctaggaggcggagaggttgcagtgagccgagatcatgccactgcactctagtctgggtggtggagtgtgacagtgtatccaaaaaaaaatactgagattatgcaagaatctgactcgaagaagtttgaactgattaaaaagtaccaaatacttcattatatgaggccagctatttagactagtcagcgggtggttcaaatgcagaaaacagatggctttcattagccagaaaccttaaaattacataaatccacggatgcaactaagctatggatctgtgccctctccttgccaaacaggacctctcagctagcaaaacagagagctccttgttcacttttccctcctagttgagaccctgttggggaggaatgctgccaagcctgctctataaggaattttgatctcctagatgataacagagagaaactttttggagaaagggaacaccctgtttgaaaggacaacaagagaacttgttcaagaaggtggctttgcatttaattgaaaattgtagcaactgtaggcgtagggtttccagattcacatctgcagactggtccagattaggtatatatgtttatattcgtttatgttatccccttaagcctcttttaaagccatttctaaaaattgctttggaaagtccatttcacttcagtattctttatattgtggctcaaaaatattttttttctggtaacaaaaatattttctttctgtttttaagacttgtagcatttttaagtttgatatgtacgtctctgtagttcagagcacttggtaaacagcctcttgcttttgaggcaatttatgaatgcttcattgtttttagctggttattttgttcattgtcaggaacactgttttcccatgggaaagcatctccagttttatgatgtcagtggcaagtcattcagtttacaagaattaccttcatattcagtcttagaaaagcatagaccacaaacggccagttatatcacagttctcatcttttaaatgttgtcttagatttttgcaaagtaatcttaactcaccttagaatagtgttaagacataaatagaactaaaatgtagtagttaagtggttatatttcccatctactaaggtatttatatttcttttcttttagaaaataaaaatgtttaaaaaattaggaataattatctttaggatgactttgtaagactgtgcttttttactggcagcaaatacctgccagatttcaggtatttggcaggtaaattgaatcttaaaagatttcaattttaagagtgtccatattaacagatcctgaataggaccctgtgtatcatttattaagtcatttcttggaggcttcactcaggaaaagggagttaacccttggatggcaatgtttaatgtggccacatttccttctggctgaatgccagggagtggctgcgcttagcaaccaggctttgtttcataaatgggttatttgatgcaggtgaggatgccgtgagttgtttgtcttgttttaattcagggagacaggcatatgtagtgaaagcatggaattgtttgcagatgggcttcagtaagaataggaaggtttctggttcaatttgtatctccaagctaattgctctgatttccatatacacatctggtgttggttcggggggaaaaaattttacttgagaaacatggcttttgtgagttgatatttatttgtgaagggcctcttgtaatgtcaaatgtaagaagatctatacacacaaccaattttacaatttctaattcaacagcttaccctattattgaggattcgcagtttaaattattaaatgatctccacttgaagaaaatagagcatgttaatcatcacgattctccaaacatttatttttaaagttaatattaaatctcatctggtggaaaacctgacaggaactgaagcatatattttctagtctaaactctcattgttaaaatgaagacaacatgagacagttatagcgccgtaatcaagttatttgaaaaaaatgttttaaaaattaccactttttggtagtcaacatacacacatatgccaacagatggcattaaaaaatggcaagaacatgagacaattatagggtcataataaatttatttgaaaaaaatgtttaaaaaattaccactttttgatagtcagcatacacacatatgccaacagatgacattaaaatagctgtaaagtcaagaagcagggaggatgacaaagtgaaaaatagaagaaatcaaaggaagttaagtcaaaagaggaaaaaaaaatgaagcatttacttggtttgtcaggtagggtgatccagtgtattttgccaaaaactttcctggttttagcaccaaatgtctcagaacatggcagctgatgacctccctcacagtgagtgatcccagagagcaatgaagaattgtgatgcccttcatgaccttgttttggatgttacacatcatcatgcccttcagtgacctttctggtagcaaagggtttgtttttaaaagagttgcagcatctttaagtctaatatatacatgctcggaagttacaccatcatcacttctgctgtactccatttgttgcacagacagaccctgatacattgtggagtttcccagggtccatgaatagcaggaggcagggactattgggggccttcttggaggctggctaccctggggagagaaattgtcaatttcctctccttgcggggaggaaatggaatcaagtgcatttgtattgacaagaaggtagaacgctttccttagacattgtaatgaacagattgtggataaacaaaagtacagagagagtttgaggcagaggaggagactgtttcaacagaatatttaccagctatggtaaaggctcattagtgtctccgtacagttaacaacatgctgccaagactggaaatctttgggacaggaatgaattcggaaggtgaacagaataaagtactgtgggaacaatggcgattccattagtggattgtacattccttacgggcagggccctccatagcatctgatgtagggccttatccacaggtatctgattattatttgactttctttaatgtttttgcagtgttattatctatactacttatttcagtaagattgacaacatttgcatttcgatttctaagatcaagacaatgaatttcctcttaatccctcaggaaagctgtgaaatttaaatttatagagcattctacttagcctgctgctttgcatctgtcagagaatgagaccccccagtttcatggaagtcacaggaagtggcaaggggctcagatggagttgaggggttctagctatttctgcagatgatctggatattttggcatcggctgctttgacttaaccatctggcaatgtaaaggcagaatttcgttaaatattggaaaagttacttgaaaacatggctctagagattttgccagcagcttttgcactcatgacttggttcaatctaagacctgttttgtttttttgttgtaaggacctaagtcctctgttgggttttgacgaagtatgtgtaaaaatgactaaaatggccagaggtatcttattttacatttatgtgggaagaaatgtttggaaactgtttcatttctttaactgaaaatttctcagtgcaattttagttggtgtttttcctcctgtggacagtttttaggaatgatacaagttatcgtggaatcacccagttcttgagtgtgtgaacgaatggcttctgctggaagttaattcttcttggcatgggtgtctcacatttccccagcagctggatttgacaagggagggcctatcatgattaatatgccttctaattgattggtttaataacacctttactcctgtggatatatttttcatttcttgctgaatttttttttctttttgagataccagaacctgttaagtgacacggtatagatatttcaggacttccattttctcttttaaaaatatttttgtaaaggtaatgcctgtacacagaagagtttgaaaatacagaaggcaccctttttcatgaagttattttgtgaagtggtctattgcctgcaatggtaatagctaggaccccttacttactacccagcaggcactatgtagagctccaaatgagaaaatgttggctccttgcagatggttgggagaggagacaccagcactcttaacagacttgttaagagttgagactgataaccagagaatattctgggggaaaccaggagggatcgccaacatactcagttatatttgtggatggtgaattctacagtgaatttttctgttcaaaatcataatacagtcacttgctaactaccaacgccatacttgctctcagtgctgagaggtggcacaaatattattttcagtcttggtcatcaggcagggcctggcaggcatcatgctctgtgtgagtcagtggagtttattataagaatgcggtagcctccacagtgattatatttattataggaaaacgtgtaattttgttgtcagaacctttcagcaggtaccacaaaatctcatatgggaaaacgtgtaaatttttcatgaataaattcctttcggtattggtaatttccttctctgttttagtataaaagaaagcattgccttataggtggctaagaacatctgtagcatacataacacttaatctaaaggagtgttgaagaccgggctgattcctaattgagaatgagcaagaatagaactctttttgatagttatccctgttcttcctccaagcctctgccttggagctatggatactataactaactgaagcttcttctttcaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtaagtcctgtccggtggctagcaattcacgttggatcacatgcatttgttttcaaaaaatttaacttcttgtattttgcatcagtattttaaccctacagtaaaaatcttggttcctaatgattcaccataccattaatatatttatttgcattaccctatgatatacatataaatgtttttaaaattatgatgtcgtattatgaccatcactaaacagtagtttaagatgtcacagcacttttttttttcctcactctgtcacccaggttggagtgcagtggcaagattatggcttactgtagccttgacctactgggctcaagcaatcctcccacctcagcctcccaagtagctggactataggcacatgccaccaggcctgactgattttttttaatttttagtagagatggggtctccttgtgttggccaggctgtctgaaactcctgggctcaagcgatcctctggctggacctcccaaagtgctgagattacgggtatgagccaccatgctcagccctccacactcctttcatcttcagtatatatctcaccacggctctacagtcaaggtcttttggttaaaagtgctagcattaatttttttctgttaccagcttgatacatattttagttcatttgtatctgtttgtattctattatagtttggttttttcctcccttattaattttactttttgactatcatgttagttctatgaaatatactcagaaagctcacttttcactcattctctattgataaacattttcattgttcctgatttatttttttggcaaaagaaaatacatatttttccttcttgtacaaaaaaagtacaaagttcactgttctgcactttgcttttttttttttttttttttttaacttaactttgtatcctggaaatcatcctttgtcatttcgtggagatcttcatttttgtttaattctttgtagtctttttgctgttactatacagggtgctcctttcttattcaatttaaaatagctggagttccaggcattttatctcacacttcttagatagttatctctgcatgtgactgcatcttaagaacattagaagtaattagtcttatgcttgttggcaaagcagaattctcgacactcattataaacagcagatagcctggcaacattttcttttgttgtaatcctttttgtactagaaatttttctttagcctacttggataatgaatgtttgttgtttaattaatattactattctattgagatccttttattttaaattgtaaatactaaaattattattattaaaaggtttaatttgttttgatagcgctctgtttaagaaaggacaagctctaattactaattggtgttttgagaagcaaaaagcatctacattatcacaatatattacatattaagtaatttttatcttgaaaggagtatgaaccatgatgtgaaatgatgaatagtggaaatcactaatacttaagttcattatatgtattttttgttttgttttgtttttttttgagatgacatcttgctctgtcgcccaggatggagtgcagtggtgcaatctcagcttactgcaacctccacctcccgggtataaatgattctcctgcctcagcctcctgagtagatgggactataggcacccgccaccacgcccagctaaatttttttgtatttttagtagagacagggtttcaccatattggccaggctggtcttgaactactgacattgtgatccacccatgtcagcctcccaaagtgctgggattatagccgtgagctaccacgtatggtccattatatgtatttttacaagaacattctgtgtgctgatttactaagtatggattgataataaatcagcttttgcctgggtgtgacttttataaagtgtcaatgttagaaataatatttacattctgctgaagagttcttgtagtacaattgtgtagataagttataaattttataaatcagaactctgtgcatacttatatgtttttgataccatttttttgatatatgcatacagactatgtattctgagtgtcaaataaactttttttaaaggctagaattaaaatttagtttatgacattgaccaaattgtccttttctggtgaatcgactattttgatacatgtgtcatagtttgcatctaagtttttcttcccttagtttcacgtatgaataaccagatgttttcacatttgtatggtggccataccaaaaattactcttcttgaccccaggaacacccctcttttcccgtttcacttagagatcctactaatgcctgggtagctttactttctgtcttagcctgttgtttgtcccagggtgtattagtctgttctcacattgctgtaataaactacctgagactgggtaatttataaagaaaagaggtttaagtggttcacggttccaaaggctgtatgggaagcatggctggggaggcctcaggaaacttagaatcatggcaggaggtgaaggggaagaagacacatgttcacatggccagagcaagaaagagaaagagtgtgaagggagaggtgctacacactttcaaacacccggatctcatgagaacactgtcacgggacagcactcgagggatggtgcttaaacattgaaaccacccccatgatccaatcccttcccaccagaccccacttccaacactgggaattacaattcgacatgagatttgggtagggacacagagccaaactgtatcaaagggttgagcacagagtggttcttcccagttctggactttaccagattgttggtggccaccatgagtggggagaattagccctttgctgtcaccttcctcttgcaattctggtattatctgtcctctgcctaccacccacccacggaagtcttgttggatgatacacaccagccagattcttcaacattaggcgccataagtaagaaagggccaaaacatcataccttgtgagccattttaatggatttgggctttattttgtagcaacaggaagtcactagactttattttttatctatttatttttttctttttttttcttttgtttttgagacagagtcttgctcttgtggcccaggctgcagtgcagtggcacaatctcagctcactgcaacctctgcctcctgggttcaaatgattctcctgcctcagcctcccgagtagctgggattataggcgcctgccaccacgccgggattttttttatttttagtagagacagggtttcaccatgttggccaggctggtctcgaactcctgaccttgcgatccaccctcttcggcctcccagagtgctgggattacaggcgtgagccacccgcacccggcctagactttattttttcagagaagaggagtgattgtagatttgcatttaaacaaatcaccttcttgctttatcactatgtcccctaccatatatcttcgttctcccagagactgccatgctgcagcctctagccgtgtgctgtccagtactgtagccactggccctatgtggttgtttggcacttgaaatgtggctagtggaaactgatgtgtgctataagtgtaagatagataccgtatctcaaagatataatgtgagaaaacctgtaaaatgatcacattcatttttatataggtttaacattgaaatagttatgttttgaatatgttgttaaatacatcataaatgttactgagttgtaactatgtgattaaaattgatttcacttgtttcttttgacgtttcacgtggcagtgaggaaattgaggttccataggcagttgcattctgtttccgtggaacagtgctgttctctgtgctatcccgagccaccagtgactctgagctgtaagggtcttagatcccatgatctggcaagtgggagagggaggtagaaatgagtccctccataccttcaaccagaacttcactgcatgttgcaagtcagggaacaaggcttgtttggggtccttttaaatacatctttcattaaatacatttggatgtaagatgattatatgcctttctagaaccctgtggtgctctcttcctcctcagacataatgtctttggatactaagggtgcattgatgaacagaacacagggcctgttcttcaaagggggagaaaagcttgtaaaatcataattttagcaatctaaaaactacatggtgacagtgacactaataccatcagcattgagcattcacaaagggtcacaaagggtcagctactatgctaagtacttgcactcattttacccactcagtgacacctgtggagaagaaccgaaggaaagcaccttggggaattgcagcattgaaggcaaacaaagagagacgattccccatgagggagatgagcagtggccagagagataggataggaagtaggaggcgttacatgctggaaggcaagccatgtaaatttctaaatgaggggaaagataagagtgcaagcatgatgcaaacggaaagcagttgaagtgtagtttttgacatggtaaaatcatgtctgtcatgcagactgaacacatgtcaaatattttattcaattcattaatgagatgaactgtaagatgtgaaaaatggttcattttgacttggagagatttaaaattccttccccagcacacttgagttgcatggctatgaacaggaatcatctggaattatctggaatatcgtcaaattatttccatggtacaggaacacttgcattgctatggggtgtctgcagtatccatctttacaaagctctaagggtgtggaatagcttgtaaggatgtaagtaataagggtgtaagaattttaagggtgtaagtcgtaaaatagcttatttagtagcaagtcaactggaggaacatgctgtagaatcagataatcctttccccgccaccctcagggtctgcaagacaacacctgcatttcaatgctaggacacccagcaatctcttttgctcatatcttgtttttggacatttgtatgtgtgtgtgacaaaacattgttaggatctggcaaatagaaggtcattgttgaccctgtggaatagcatggggagaagttacgttgtagtccattgcaggaaaaacaacgtgggtcaatggtgagtcagctgtggactcctggaggaaagacctagaggcaaaaagctttgaggtcattgaagacaaaaggaaaggctttgtgattttgatttttaaatggaaggaatttgggcctaaggaagcttaaactaaactgtgggaaggactgatacccatcctaagcactagttgcaggtatctcttaagaactaggttttggccgagctccgtggctcagacctgtagtcgcagcgctttgagtgagaggatcgcttgggcccaagagtacaaggttacagtaagctatgactatggtattcagttctgtaagaactaggcagaaaggagatccagtggatatgtgattgcctgggtcttggaaaggggagggaacatctccttttctgaggaagaatggggagatagggtgggttaattaggcagtttcttttgccaggtgataaaaaccccctaaacaatttgtattttatatatggagaatattttctcccactgatgggaaggatcgtagtgtgggggatgcttacccaatttcttaaaaatgtacacagaaatgagatccctaggtgctggaaccgagggtcagtactgcctagaatttccccattagggtctcttttgtttctgcttaccttcctgctgtgtgtttactccttttctcctgctaagatgggtgtcctcaaggagaccagggatgttggtagccacgacctctggtagtgttagtcctggtttggcatcccaactttgttctgcccatgggcattatcagggagtgcttctggttggcactgctttgagttacacgtctgcccttggagccaccaccgtatctgcagggactcagtatcaggactagcccatcttggccttgtgggtgtggccgtgtgatgtggggagaggagctgttgccagaagagggatgaggaatggcatgggcaaaatagaagaatgaccccagtgctgcaacacagtgggtatggattagaaaaggcttgtaggctggacagggcgaggtgagggagtgcatcatgcattaggattttaagtggctttttggggagtattgagcaggtggcaggggagacaagttcactcagaagttttagacagtgttgacattttctttcaaattgtgcatcttgaattctctagaacattctttatagatatttcaggatcttcctgccactttccacattgtagctattctggtgtttttcttttataattagaaataatgaatagttctcatttgtaggcttggattttcatgcgtgtgttggaaagtgttcgttttgccttttttttttaacttcatgtttttattttttaaaccgtattgatggattcattgctaggaacggcaaggaaaagaatactctcacaatgttaccacgtttccttctcacaggttttataagttgtattatttttatattttcaaagttataatcttaccatctcctctgttgccatacttctcattcatagggtctgtctttaactggactcattgtttacagctagtcttttcatcagatcatctcaaaccctgtattacattaatattttgattccgttttgttggatgactttcatcttaatcattcttattgttgaacaatgtttttcttattattgaacaattgcttcattaggtatagaattcctggttgatgggtgtttgattcagcaccatgaaaattcacggtattctggtatctgtcattgggcaaattcttcttctttttttttttttttttttttgaaaaaaatgcgtggaaaccattagttaccattgacagagctactcatttaatgattttttttttctcccaatagtggtggatgaattttttactttgcgttctcactttgtgtctctcatgaccaaaatattttagagataactagctggctaagtctgaggtggctgttaacagtctggtcctaggatagaacaaaaccaacagaactcatcaccgtcacgtcgttttgactttttgctcacaagtttaactcattgtttaatttgtttttccaaaggattgctttgcagtatacatgttggtgcatagcttaacatgatgataaatacataactttgactgtgaattatctactctgctcctttcatagtctcatgcttctctgaatttgtattttgtgttactgggttgttttgttgttatcattcatagtgttttttttgcccttgattctttgatccaggttttggtcaagggcaaggttcaagagaaaaagtaaaaacacagtcttttatttttgctcttggttataaacccttgtaaagtttgattgagaagataacttggatcttatggtttaaattgagtctttgtttaatcccaagtcttccaaattctttgtgcttatgtattctttcctctttcccaatcgtaatagttttgcttctgcctagtcattggtcaaatacctgcctttcaatgcatttaaaaaatattttgtgttagcaccatttgagatttttccccccttttttttcaagtatgtattgaggactgttatgggatgaatgtttgtgttcccccaaaatttagatattgaaaccctaaccccaggctattcggagatggtattcggagatgatacctttgggaggtgataactgttagatgaggtcatgagtatgtgcccccgtgatggaactagtgcccttataagaaaagataccaaagagcttgcctttttctccctgctcaaacgaagaagtcacataaggacacagcaaggaggtggctgtctgcaagcaaggaagagcggcctcaccagaactcggtcatgctggcaccttggttttggacttccagcttccagagctgtgacaaaagacatttttgttgtttaagccattcacagtaaggcagcattttgagctaagacaaagacctactgtggcttctgtaggcaaaagccctacagacccaaagtgttgtgagaattaacatttctagggatcatgccttacagtggattttatccaacacttagctctgacctagagcacgctagtcgtcgttaggtaaatgcttgtggatggtagtttctggcacagagattggagcggtaatgggcaggagttctgtatccagcttatgctgagagagcttcccataaaatggagcctatactttccttttgcagagaccatttctatccattgatagaattcttttttttctttttcttttttttgacgggatctcactccatcgcccaggctggagtgcagtggcatgatgtcaacccactgcaacctctgcctcctgggttcaagtgattctcatgcctcagcctcctgagtagctgggattacaaggtgcacgccaccacatgtggctaatttttgtattttggtagagatggggtttcaccatgttggctaggctggtcttgaactctagtgatttacctgcctcggcctcccaaagtgctgggattacaggcatgagccactgcacccagccttccatcgacagaattctaaagacatgtttaggcaagagttggtggaatgttggcgtgtagtccagatttgccttcagtttgtttttatccgcttcaaatgcaaaggccatgataattcaatagtaaagtcataaatccatagtatgacttaaaatatttggttgtaatattacaaagtatgcttccaaacacattaagcatgcaaaatccttatattgttctttttgtttagtgtttagggtagtttgtgtgaatcatagatgaccacagtagactgttgagttgttattttcttttgacattctttgatagaaaacagtgcttttcctctgttatttatactagaagcaaaaagtatctctcatagcattatggaaacaactcgaatacaactacgtcaattattcatcttttttttttttttttttttttttttgagacagagtcccactccatcaaccaggctggagtgcagtggtgcagtcttggctcactgcattctttgcatcctgggctcaagtgattctcgtgcctcagcctcccaagtagctgagattacaggtgcccacaccattctcagataatttttgtatttttactagagatggggtttcaccatgttggccaggctggtctcgaactcctgacctcaagtgatccacctgtcttggcctcccaaagtgctgggattacaggtgcgaaccactgtgcctggcagttattcatcatttaacagcataaagtggccacttgctttaataaactattatagtaccaaaattttggcctgaggaatttataaatataaatagaacaaaacaaaaataatattccccttgaaacatattctaaaaccaggggctaaaagttagaattgttagattttattgtcctgtttctttgggatgaaatgaaattttttaaaaaccatagttttggccgggcgcagtggctcacgcctgtaatcccagcactttgggaggccgaggcgggcagatcacgaggtcaggagatcgagaccatcccggctaacacggtgaaaccctgtctctactaaaaatacaaaaatatttgccgggcgtggtggtgggcacctgtagtcccagctacttgggaggctgaggcaggagaatggcgtgaacccgggaggtggagcttgcggtgagccgagatcgcgccgctgcactccagcctgggcgacaagagcgagactccggctccaaaaaaaaaaaaaaaaaaaaaaccacatagttttacttaaaccaaaggctttgggattccagaagaataaaggaagtgtacttcaattctacatctcaagaatctatttcttcccaaatttaatacaggcaaatttagtctatatttattgggcactgttaggtttttgtgtcaggtgttgctgagtggcgggataccattcttggcccataaggaccttataaatctattaatacaattaaattgtgaagaaaatttagaaaattgcaaaggtagaatgaggttgcaaattggagggtcttattctggagataggtggaagctatggcagatttttagcatgaatgctttctggtcaagacacttttagaaaaattagcttgtttccaagagtagattagattggggagagaaggaattcaaattacaaaataatagtgtgaaaagcattgtgggagatcatcctgtccatcccctcattcatgatatcctgaggtgctgtattaagggcatcattgctctttgtcacccgagcagtccaggaaggctgcctgttcagtcttagactgtatcctcacagtcttaaaccatatcctcactttatgatagaaacacacaggcaagtgttgtaagagttacatattgtcagttaaacaagaaattggatgagtccccatactattcttcctcttttaaagagagaacttgggccgggtgccatggctcacacctgtaatcccagcacattgggaggccgagtcgggctggtgacgagatcaagagatcaagaccatcctagccaacatggtgaaaccccgtctctactaaaaatacaaaaattagatgggcatggtggcgcacgcctgtagtcccagctactcgggagactgaggcaggagaattgcttgaactcggaggccgaggttgcagtgggccgagatcacgccactgcactccagcctggcgacagagtgagactccatcccaaaaaaaaaaaaaaaaaaaaaaaggaaaaaaaaagagataacttgaaacaggctcttccagcctctctattcttttaataacatgcagtgcacttcttggagctaggggctagggtctaggggcttcttgaaggtgttgatgtctctggtaacttacactgcagggcaggtctctggagggaactttgaacaggttaagcctcaaatgcaggcagagatttccaattgggaaagttaggtgaacgtggctttatcatctcttttattggtttatgggtattttctctttttcctgttttctttcccaccatttaacattatctgttctctgcctttttaaccttctggctttaaatgaacagttgcttaatctatagattaacaggatcagcaaacaaagcacagcagtgcctgcacaaagcagaaactgcctgttagatgagttgagcaaaaccatttcctttgcccaactttctcctctaaaatacataactgaacatgggattcccagacacgaattgtttctcaacctttctttttccattctacagttgtatgaaattaaaattaaataaaaagcaaacaacagaggtagtctttttaatcttaccgagttggaaggtatactatatacattatcctatggtagaaggtctggtacattcttgaccattattactttgctatgggcacccttcacccttgtaggctgaaaattggcaaatcataggcacgtatacattgtggttttggaatttgaaagatctcaaattcatattgagtgagacagtttttgaatggagggatcaggctgtctatatgtggatatattttatgcatttctggtctgtataaatgtaaggattgctttactgaccgtagatttcttctagggttaaaaagttgaagccagtttggatattttaaaataagaaaattagccctacattgaaagagagaataggaaaatctaggctatgtgtacacatctgcttgtgttttcacaattgtgtcctgtcctatttatttttatttctctcccatctcttccctcccacccacaatttgtttttcattcaacactttgaaattagaatagcttatctatcaaacaaggttctttgacaggattttccaactctgagtatgaaagtgtggatataacaatatatttatatagaatgtcagaagcagagtttggccagattattgggaaatattctaacgccctgcagcattttaccgcctttgcttttacataaggccatcatttggaaacatagcatgctgatacctcccattattgcagtagcgtttcatcagctgcacgctgcctctcagcgcctcattaagttgcaagcagagaacgttttcgttttccagttctctttctcaattaagttagagattgtattttcagtattcctcattattaaaagaatttttgttgagaatagtttaagatgtgatatttctttgtattccaggaaaatttaaagaatgtcattgaaatccagaaacagaagtatatattgtctaggacatgctttgtcttggtttatatgcctaagtccgagtagtttaaaatttatgattaatatactctttgaatgcttagaaatggcatcgattttagttgttctagtttcatcttaaataaattggagtaattactaactcaggattatgatgtgctacacataaaacatttgcagtgatgtctggtacttaggaaaccctcagttatgacatttttcttactttcttcttggatatgttctttgaaaaagggactggtatggaaaagctttgagacgatgaaaatatacaagataggctatctctgaaacaatttggtatagagcatttgattctctgtttcatgtatatattcatatatgctagctgcagtcatgcagacacaatttggatctgggtttttttttttttcctttttcacatgcagttataaatttagaaacctggctgtttcctctggactaaatgtatttatttaaattttcagtgctttaaatgcaaaattacaagcatatgtacaagtagaaagaatagtaaaatgaaccctcccatctatctgtcactgaattgcagtaatgatcaaatctagtcagtcttgttcctgagtcagtctggaatgcaggttttttcccttaactattcaggttctccagcaatcctggcaaaacacatgcgggtttcagctcatctctttcagtgacctgtaaattaagatgtgctaaagcatcacatgttactcattgacgttttgttaatatatttaaaacattttattagtaccacataatttttagcgttttcaaaaagaaataagaatttggctaaaggtgaattttaaaaattgaatgactaagtagaaaagtaggcaaactgttttcagaattagtagcaatttccaattccatttactctgttcattaactttgttttcagccttttgttagccatgtttgattttgtgtttttgaaatacctttggtcattttaggacttttggcattaatcacctgtcttaggtggcctgtttacaaaagggacttttcggttctccatttgcccttaatgttgggaatagagacaaagtttctgtaggactctgacaacatatggctttacaaagtttttttttaatatatacatttctcttcttggctttcttaaatatcatcaatgtcttttcttgctttacgtatttagcaacttaaatgtcatcttgtctgagatcaatatatttccaacttggagagatagtgagaagagagacttcagatttttaaaatgtggaacaaaacattctgatggtgaccaggttttaaggtatttcttcagtagacaaaactacttaggctaccgatgataagcttttaatattaataataattattatatataaaaatattaatataatatgatctaagattgtttctattccccctctttcctggttgttaggatttggaatttcttatgcactctttttttttttttttttttttttctgagacagagtctggctctgcctcgcaggctggagtgcagtggcgcgatctcggctcactgcaagctccgcctcccaggttcacgccattctcctgcctcagcctcccaagtagctgagactacaggcgcctgccaccatgcccggctaatttttgtattttttagtagagacggggtttcaccatgttagccaggatggtctcgatctactgaccttgtgatccacccgtcttggcctcccaaagtgctgggattacaggcctgagccaccgcgcccggcctatgcactcttaaaattatttcatgtactgatacattcactttcaatgataaaacatggctgtatgaccaggtaggtaggctgcttttcagactcctgtactaactgaatgggccccattagcccaagtgagagcttaacttgtcactcttcctaaatgccttcctcagctgagtgcttatttacagtaatctactgcttatagcagatgctatgatttgtataagctgtccatatctacttggaagaacaatattgaaaggcattgagatacttactttccctcaaaagcccataatccaacaactatttagaatatcttatttaagagataggtttataatacccaaagggaacttaatgtatactgaaagtccctgattgaatggattctgaccttaaccagaaatattaattacatgcttatcagacacttactgtgctatcccagggtttgccactgttgagggaacaccagatgaatcatattgtccctgccttcaaggattatatattctaataggacagacagcccatcagcagaataggaggtagcaagtggtcagggatcagataaagtgatcaaggcaagtggaggatgcagtggtaggacagaatggtctgcgcacagagattgagggcatcatgtggtgggaattagtgaactagcatgcaagccgggcctttttcttggcttttgttcaattggaaggagcataaagctactaaaggagcttatgtttagaaatagggcttattgaaggggacaaggcatctcctagaatccaaatgcacatcccaagacttaaaagagttagagggcacaggcaggccctgtcagatccggtctctgccagatccagtcttgtctgtttctcatcttcccttgtctctctgagtattccctgttttcctttcctggactaactgcttcttccagatgcctagtttgagtccacccatggttttttgggggcttttctttgtttttttgttacgttctgtttttgttttttgtttttttgaggcggggtctcactctgttgcccagactggagtgcagtgacgtgatcccagttcactgcagcctcgacctcctcgcttaagctgtcctcccacctcagcctcccgagtagctgggactataggcgcaagccaccatgcacccatgggtgttgacatgccacctgtggctcagacttatgctcacctccagtcaagtttcttccttatctaacgacagcctttgtgtgttcgtgaaagcccttgagggaaagaatgctacgtacagtttggttttcttgggctctaataagctataggggatggtgctgcagagtttgaaatacagtcactaatgagtcctccttcagagagctgagggtgggagcaccacataaaaggagttgggggtcagcagcctcctgatagtctgaaagccaaagatgatggatgtggggctccacggggaggctataacatgccacgttatgttttctgcccttgaggaaagcttcttttcaccaggcaggcagtacagatacaaacttaatagcgatgtgaggcacactgataaataccagaaaacattctgtaagaggggttagcattatttcactgtgtgcagaggaggtttgtccatgtggggggaccctaatgggcgtaggcatttgaagtgtagtctaagggatcttaggtaagagtgtgtttggaacacagtgtacgtatttatacagcaaatgctctgtgtggctataatttaggaaaatttgtaggacttgaggacagcttatttttctactagctgacagaggcttgggtttgcttctgctttaagtataagtatctcgagtccttttttaaaaaggaaaatcaaggaaatagttggaattgggtttcacataaaaaacattttagaaaagaaggggagtatgagagttaggatttgctaatgtttgctgtattagcaaattatttgcaatgcttgtcatattagcaatacatgtatgttttggaaaacacatgcaaattaagcagcttaaggaacttttatctttatttcctatgtaagatttgagatgctgcaaagaaaatattaaaacattgaaccgatacttacagtagtcctcctatatctgcagaggataacttccaagacccccagtgaatgcccgaaaccttagatagtaccaaacccaatatatactatgtttttttcctataggtacatacctgtgataaagttgaatttacaaattaggcacagtaagtaattcacaacaactaataatagaatagagcaattatgacactacgccaccatcactactcttgcactttggggccgttattaagtcaaataagagttacttgaacacaagcgctgtgatgaagtgatcaatggcaggtagcatgtacagcatggagacgctggacaaagggatgattcactttctggactgtgtgggtttgagatttcatcacactgctcagaatggtgcgcaatttaaaacttattgttggctgggcatggtggctcatgcctgtaatcctggtactttgggaggccaggacaggaggatctcttgaggccaggagtttgagaccagcctgggcaacataggatgaccctatctctttcttaaaattaaatataggccgggcacggtggctcacgcctgtaatcccaacactttgggaggccaaggcgggtggatcacaaggtcaggagattgagagcatcctggccaacatggtgaaaccctgtctttactgaaaatacaaaaattagccgggtgtggtagtgggtgcctgtagtcccagctactcaggaggctgaggcaggagaatcgcttgaacctgggagatggaggttacagtgagctgagattgcaccactgcactgcaacctgggcgacagagtgagagtccatctcaaaaaaaaaataaattaattaaataaatagaaaaataaaactcatttatttatagagctttctatttaatatttttggactgaaactatggaaagcaaaaccacagataagggaggactactatagttatgataaaaatcaggaacttaatctagccacgagaacatttgtatttctgatgaaatttttattcttgtctaaaatgttgaactatatttatatttatatctttaaatataaatgaactatatttatatctttataaatgagctatatatttatattttatataaatataaatatttttatatctatgtaaacataaaaaggctttttttcctctctggatgtttactggggttatttaataaaaacctagggatgatattgggaatttttgttggaattttaaattttaacgtgtttgtttctttttttgttttgtttcgttgtttgctttctgagctgggagttggctgtgcatgtggcagttgctttatcaaaagggtcttgctctgcttcagaagaagttttgttaccttgattgctaatgttctcccccttaaataaacctcctgatgttggaacagcaaaattgcattatgtttggaaaatctaaattaataatcccttatctctgaataaaagtaactgaatcaggttgaatttactgcttccattttaataggacagtaggaaaaaactatgcatgggctttatgtggttcaaatttttttttttttttttttgagaccgagtctcgctctgtcaccaggctggagtgcagtggtgtgatctcagctcactgcaacatccgcttcctgggttcctgcgattctcctgcctcagcctccggagtagctgggacttaacaggcgtgtgccatgacgcccagctaatttttgtatttttagtagagacagggtttcaccatgttggccaggatggtcttgatctcttgacctcgtgagccgcccgcctcggcctcccaaagtgctgggattacaggtgtgtgccactgtctccggcctggttcaaattttgtaatctccacatccatctgcatattaacaattgtcattgttggtgttatagagagagaagctgaagcacagaaaataacacgcatgttctagatttcctggtgggaactggaagtaaattctgtgtttggctgatcactgtataaagttctagtactagtctttagggaaaagccccgtcttcatggattttaatttgtcaatttgcaattctacctacttggaaatagtcaacctaatcagttactgccctgttgcaccaactattaccataggaatctgaagatggtatgcaaccaacatgaaaaagagatccttttctcctggtaatcagtttgtaccctacaaacaattcgttggttttaagttgtatagagggaaccatgatgtgaatatgcctgccactgggtttatagaaaaccgatgactcctgaggaaattctcagcagggttgtctttcagtgaaaagaaccctttagaaagatgcagtaactcacactttactgcacataaagtcatgtccctcagggtggactctcaggtgtcatacagtttatgactcatgagtgctgcagctttgtgatctaataaacaagtaaagacggtgggagaattatattcctgtacaaaaagccacttcacctttcattatataggaaaaaagccatgggaatattaaatttttagtggcatttttagagcattttctgtgatctaaagtgcctgcattgagatattaagatacttaagaacaaagtaaaataaagagaagtattaatagcaggatccctttggagctaggttactgtggcagtggtttcaagaataactctctcagcacccaccccaggattctgatttagagatttctttgtgtgttctcttagcatatacctctaccactgagtttatcccctgctgctacactgattgataccttatttttaaatttttgtttttaaaatagacggttttttagagcagttttagattcacagaaaagttgagaggaaggtacagaggtttcccatatacttgctacctgcacacatgcttagcctctcctattataaacatcccccacagaatggtacatttgttacaatcgatgaaccaacattgatacatcattagcacccaaagtccatagtttccctgagggttcactcttggcggtatacattttttgggtttggacaaatgtataatgacatatgtccatcattgtagtaccatacagagtagtttcactgccctaaaaatcttctgtgctctatctgttcatcctccccctgcccccaaccacccaaacccgtggcaaccactgatctttttagtctccatagttctgccttttccagaatgtcatatagtgggaagaatgtcatatagtatggagcctattcagatgggcttctttcacttagcaatattagttaagttcctccatgtcttttcatgggttcatagcccatttccttttagtgttgaatgacattccattttctaggtgtgtaccccacagtgttatttattcattcacagtaccttattttttaactgatttttttggggtctgggactaaggtgaggtaaacaaggcagtcaggaattgagattaagaatttttaatgtaatatttttaaaaatcaaaattactgcaaaaaaactccatgatgaacaaaatatcaactttttagacagagattgagtcacgctcaattgacatcaagccatgcatagttctcctactgccttattaaaatggaagcagtaaattcagcctgattcagttacttttattcaaagataagggattattaatttagatttgtcaagccctctgaatgtcatggacaattgtgagtgaaattccgtgtatcgtctaactccccatggatgttatcttgctcagaaaccttgttctccctccaaggaaggcactacttctcctgtagccttctcaggtcgaagttcttttctcaaaatcctcacagcgttgcccctagaggtgggaatgtcctcttttcctcttcatttcctcttttcctcttcatttttgtttccaaaccactcttcctttctcttccctaaaagcccccctacctcagcttgaagtgcatgctttcagacaaatcactttgctcctccacctgttggtcatctccagacctctttctacctcatcgatgttcaccattcagactttgaagattttagctcctgccttgctgtcatcaggtgtagctgctcatttgctgattcttaagtgatcctaatattgatctcaatgatccttccagtattccaatttgtcagttcatgattctcatccctccagtgaccttgttttcatcattctccatcacccattgcttacaatggtcatattatactccttgcaatgaccaatcactgcaactcctccaaaattttaatttcaattatttgactctccaagtactacttattaccacctcactttctccagtcctgtgcgccatacattctttagcccctggagtgtgatcagtggactcagattccactggtccctaccaccttttacctgtgtctaattcccctcatgttctcacttttgccacttgagattgcatggcccagcattctaatcattcccttgcttataccgtcacttctctattcgttgttatttatctggcaaaacaaccaccctgttgcaatgcaaggtttatgcaagggaatgcacattttcgaaatagatttttatgtttatgtttttctttcaaatctctactcattaataaatagaagtggtttgatatttcacaaatgtgatttaattgatcaagtttcacatttcattctaagtgctcagttaaacaccatgatgtattcacaacagtaatcaaagcaaggggctgtagttagttataggagcaaagagaattcatgagtttatttttatctaaatgacacccttgataacttttcgataagttattttcatgtaaattacttggaataagagcaggatttttatatagaaagctttctatgtgtcatatcctgtaaaatgtttgtccgattagtgagagatagggggaggttgaattttactaaacataatatccccagccatatctactgtaacgtttgtttaggacattacagactattatcctacaccaatttatttcacatcaaaaatcaccccatgcttgtaagaatcctcctttccccctcttgtttctattttagctcccctggaaaaataatattttaagtctaaatgagtacaataaattaaaaagttgcattgcttaatattttgaatggaatagctagatgcttgttcatttgctatctttttctttgtactgaatttctttagcttggtcagaggtagagcaggcttgactcttagtggatagtggtataggttgagtatcccaaatttaaaaatccagagtccgaaatgctcaaaaacccaaaactatttgcatgtcaacatgatgctcaaaggaaatgctcattggagtattttggattttggactttccggattccagatgctcaaccagtaagtatataatgcagatgttctaaaatcggaaaaagtcagagaccttgaaagcacttctggtcccaagcattttggataagggacactccacctgtaccttacagtggaggcttgttagatgcttgtaaatgccagcccctgcctcaagtaacaattgattctttttgtgtgctctcccaggtctaccctgaactgcagatcaccaatgtggtagaagccaaccaaccagtgaccatccagaactggtgcaagcggggccgcaagcagtgcaagacccatccccactttgtgattccctaccgctgcttaggtgagccggccggccgtggggctggtgttgattgggggcctggtcttgagggaagaaaaagaggatgctcctgttaggtcacatacacagacttgttcttcagcacattgccactctgtgttgtactgtgttttggactcttgcagttacattctgtgcactgaccctataggagcagtatttttgagttccctgcctcagaatgaatttacccagggtgtatattgaaattacaaattcctgggccagttccaggactcctgaatgaaaaatgcctatagtagcggatccgggaattcttattttaccgtatcgcatagatgattctcatgaacaggggccttgtgtgtttcttcacatagactttctagaagaaagaatctaatgtgaagctgcagcattttgttaatttctaaaaaaaaaaaaaaaaaaaaaaaaaaggctgttctacaataactactcctcttatttggtgatagtagaggaattggaattgggaaggctttttttctgcttacatcaaactggaggaaacagtctgattactaatgtttaatgtttgttttgtcacaaacctcaaatttacctcaacattttatttaaaaaaattgagtagttttatgtggtatcgtgctcttttcctctggaaactgtcatactccatatttaatctaacttggttattagtctgttcctagttgttgtttttatgtgaccagtcattgcagaagtcaagttctttgctctggtatcttacatctagatgttttccacaagtgtattcatcagtaggcaggttgtaaataaggatatagagattgtctgtggagattgtggacaaatattgatgtatattctgatgacttcttataaaggttaaaaggaatatttcaaagaaaatccaacagcaaacttacaaagtaaggatatttactgaagattccggagatctatgtaatatatggtcaaaaatgaatgtcctaagagcatactgattgctgttcattcatgtgcataatttgagacataaaatgaaaacactgggcattagaaagaagatttcacctggtgaatttacttacaatgtaattgatgaagagagtgtagaaaactagatttcttaaacatctgataattcaagagtttcctttttcctccttattccttgttcctatatgctttataaggcctcaactcttttctggttcatcaaaaagtgcagtttaattagatgaaaataagcagcacttaaattctagatacagaactcctactcaaaaaaatatagaagtcatctgtccccaggaactgtgtattttatactcacttagttattacaccaagaaataacacacagagattgaacaattcagtacaagttaggaagtagatcatgagtctgttaatttgatgggccaggctttgttaatgatttgtttcttttggttcttacttacctgttctatgaagtattccaaatatattttcattagaatgtaagctcactgagaacaggtagggctttggatgggcattattgctcctggtatgacactcaaaactgcagtcatgtttcagaagtgaacttatcattttacatagatttttctgcttcatattctattcagaatgatttgtattaaagttgatggaaagatgaaatccacattaagattgttatttactacctagtgccagttgttgtagcaaatatcctttgaaccccaggtctattttatcctatctgttgatcacttcctttgcccctgctcttcaagcctcctcatctctgaaaagctctccttccactgggtgtggtggctcaagcctataatcccagcactgtaagaggccgaggtgggaagattgcttgagcccagcagttagagaccagcctgggcaacataatgagaccccgtctcttaaaaaaacaaaaacaaacaaaaaaacctccaagtgaacgaacagtacaacaagtaataaaggatataaaagatgttctcagatctcaatatcaagtcagaagattttataataatattataattacacggagactgtccaaatatttgtatttgttgtgctacactgcattatgcaccatttagggaaacaacagcctaagtaatgtggttttaaataattaatctcatctaccaaatacctgtttgatagtaaagttaatgacctgtcctcaccttatgtttttaaccattatggaaagagaaccacttgaaaatatatcattccactgacagataattacccagctgtgaagcacaggctggagactggcaaggagaaatggagagaagcctataaaataattctttctcagggaaggagtttattcctgccaaggctttgccatcaaccattatcagatttctctttcatcctccgaacagattctgggctcctttgatgtggaggtacataattcaaaaagttgggtcacttgtgacatgttaagcaaatttctcagttctggttgtgtctgatgtgaaatgagcacgttgacactaactgttcttgactactatgggactagataatcatttgctatttcctgtaggtacttggcgtgttgaatcattttaccatattttctcattttatgaatcactggtccttttccattggacctgaaattagaccctaatatgacaagtagagcatatgttgtctcttactttgttattaaccttagattagaattaaggaatataggtgctgcttttttcttaggtagtggcaaattttccaaaggtctcaagcccagagtataatacagagttgataaaataacctggtagagtatgtagagcatgccttgtctttcaggaaaaggaactgaaaaacataggttttccaataggtgtaacataggtaacatagggacataggtgtaactgatgtacattttacttgcacttaatagacaggcagtgttagttcttcgtctctcttcacaggctatacaactaccaagatccagagaggttgaatttcttgctataactcacagcaaataaatgggagagtcagcactacagtccaagctctcttgattattggtccagtgttttttacagtatacacaaaaatttgttttaaaacaaatattcactatgaattagagacaatagcactaaaaaagaaactcacagctatcgttgtgttgacagaggagacaaccatgacctagtataggataaatctccatgtgatatgttttctactttatagtagtagtaggtaacattcttacatattattcctgcttaacaaagaattactgttcagcattaacataagtatgctctaaaatctcttgactgtatccaaatatatgttttagacaagagttttttttttttactgacctagcaaacaaaataaaattatcttaaacattaagcgtgttaaaattcaaaacaaagcttgaagagagaaaaatgcttgttatgtgtggcatacaaccttcctaacctctttatcagatgaaggatccagtgtggcactggattatttttctgtaatattttgcctcggacatatgtgctatacatttcttgtctgcatggggaaagtatgtcaggttgctgttgccactttcttcccatggagtggataatttcccttgagaataagttggctttctcatctcaccctttgcttttggtagtacctctggaaccagagggtaagattcatcttaatcatgtgaacattttattaattatctcatgtgtgattcaagcacatcattactgttactcaaggagaatattttctttgcaaagctttcaaccctttccatttgaatgactgctcttcatggtgtaatagatccactgttgaaattggcacttttctgtacttgtctctgaccagcaaaggcaaggaacattgcgtaaaataaattactgttgaattattggggcaaagtcaggttaatagcttaatccaaaaaaggaattacaagtgaaagaattttaccttaaatgtcattctgtttcattttgtaattaagaccttccaaatgtgtaagtagtaatgaccagaaatcttatcagatatggtcaaatgagaaaggtattcaattcatattaattttgaattttattgttttaatacaattttaggaaaagcatgccttgttttctgggtttcttggctgcctttgtatcaattatctacagctatcttctttagcatggaaaggatgtatttgaatactgtgacattttataccagggtaattctttgaatttatgtaaacaacaactctcttgagacacatcagtacaacacaatagtcagaaatgtcacatgagagttcaccaaactttaaagatggcgatgaggatggaaaaacatttttattgtagactttaaggatcttgtaaatccccgtatgtaatccagtgtgctagagaattggtgcccatggcgcctcctctccccaccgacctgcactgtggaaatcctactaattttgaagtcatgggagatgcatgtgtgggacctatacatgcactgtgatgagaatgatgacttcatcattctcattatttaatgagcccagctgctgcatacaagaaggatgcaaattcttgaatgttcttgattgtttacatcatggtctcataaggaatgaccagaattgctgggcatttcttcatcaggaaaggctaatcagccatccttggagagacatcagactcctttatatgtggccttcccatgggacctttgaatggtcaacgttaatcatgcttcagaaccagcatactaagtaaaagaaaacatgtccggaaaagaaatcttatcagtgtttatctcccaacagtgggattacaggtgattttgattttatttaagcaattttctatgactttgtataataaatgagtagcttttataatcagcaaaagatagactatgaaatcagtacatataattttgtatttgtatgtagtaccattgaaggataatagaaaaaagtcaaaagacttgaaagtcgacacagaatgatcattaatttgttttatctcttggtagttgtactttatgagctttatacatacagtatgggaaaatacactttagttttgaaaacaccatgatgccaaaataaaagaaaataacgttcattcatacgatcttcaacaaaatttaagcagcattaatcatcactgattcttcaggaagattcttgatcttccttaattttttttccctccaaaattgcatatggcagccacatttgtttcaggccagaaggaagaatgggaagagcttacatttatctcacagattccttctgggtgaggaagacttagaaagtgaagccctcttccatttgattaagcaagaacacctataaaaatggtgtcttcggccgggcgcggtgctcacgcctgtaatcccagaacttcgggaggccgagatgggcggatcgcaaggtcaggagattgagactgtcttggctaacaacggtgaaaccccgtctctactaaaaatacaaaaaaattagccaggcgtggtgcgggcgcctgtaatcccagctactcgggaggctgaggcaggagaatggcgtgaacccgggaggcggagcttgccgtgagccgagatcgcgccactgcgctccagcctgggggacagagcgagactcagtctcaaaaaaaaaaaaaaaaaaaaaaaaaaaaatggagcccttctaggtaggtcatcctccatggctcactgcagcacttccttggccctgtcccaagttccataattgcctcaattgcattggctcctgcttgatttgctttctaaaactcaggacagaggatgagttgaggagactgacttttttaacaatcgcattttgaaaagaaggaagcgtagtggtgtttcttggctccgtttccagttttgtttcttttcattttaattattgtacctggtattgtgtcctctttctgggacttttaacaactaatgttttgattgataagagctctaatagcatgggtgatttatacttcattacatcttcagttttgtcttctttactggagttgtattcaggtgtcattaagtaacgaggcattaaaaagaaacgataacttttgaaaaactgctgttatggcttatgagtgggctttgctgatattttcttgaagcacagaatttatctatctctgtaggtcctagatgataggtgagaaaaagaaacccagcttatttggcatgatattgtcccaaggcttgttagtaattgctttgaaaaatgaatagcaaggctaatggacatctgatttgtagtacatgctaagaattgcaaatgtgtgctcaaaagaaatttctctgattacaaaagtaacatatattcaacgtacaaagttgagaaaatacaaccactagctaaaaataatcaaaaccatttggcttccttgcagtctacatttttttcatgtatgttttgcttttgtttttagtgttatttaatcgtttcctgttttgtgacttgctttttacacctaacatttttagaatactctacctgtgaaattaaatattcttggagagcataatttttaatgtagcatcacaccagacactgtaatgtgtttactcttttttatggtcatttaggtggttttctttattttgtggtggtgtaatagttgttataaatgatgctgtgataaacatcctggtagataaatttgtgtttagttgatttttatataacagttattggcggaatgccttgcaaatcttatagttggtgtaataaaatatatgcgccacataattgtttatgaaaatatggaggaaaattttaatactgatttatgatcctgagtttaacataagcatggatacccctacatttagctatgatttttttattgatagagtaaaagcgcctgtaatttctacttaaggccatttaaaataattactatttaaatctatttaaacaattttaaatattgcttttccaaatttccaccttaggaagtagttaattgaatattctcagagaaataagtcctacaaaattgaccaataaaaggtcagttacgtattcattgtgtacgttttattgatcacccacagtgtgtgagcccctggaggtgggtgaaatgtgggcctccctcttacagagttgatagtgggcctgaaggggatgggatttcagctcaggaatttaaggaagacttgacaggaagtagcattgtgagccaagatttcaaggataagatttcaaggcaagaaaggagatgtattttaggtattcagacagagggtcaacaaagtctttaaggtaggaactagttcacttttcaaaaagaagaggtaattggtcatgataagagtagtagtttttaaaaatcattactgttttcattcatttataatgaatactattattttataattttaaagtttatatccaaataattgttttcaagatggtaatgaatgtatattgcttttatgtatacacatagtactttttgctttttggtaactaagtttataatttttgagggcaggaaatatttttgtttttcacttacaaagaaactatattttaataagagttttttgacagcagtgctttatgccaaaggaaaataaagcaacatttaacatatcaaagaaagccaatgcaaaacaaggattatttatttatttatttattttattcatttttgagatggagtttcactcttgttgccccggctggagtgcaatggcgtgatctcggctcactgcaacctccacttcctgggatcaagcgattctcctgcctcggcctcctgagtagctgggattactggcacccgccaccacgcccagctaattttttgtctttttagtagagatggggtttcatcatgttggccaggttggtctcaaactcctgacctcaggtgatccacccatcttggcctcccaaagtcctgggattacagacatgagccatcatgcccagccaaaacaaggattttatattcaatcaaactgacattcagatatgatcacatgaaataaatatcaacgtacaataactcagggcatattttcacattattttcctgtagaatctgctagagaacaagtttcagatacccaaaatacctagagaaaaactgatataaggatgggtaatgagcattaaggagaaacataaaaactaagactcaacgatggtaaaaagtatgataatatagtattccacagctacatgctgtgacaataaagagattctgtaactgtcaggcctctgagcccaagctaaaccatcccctgtgacctgcacgtattcgcccagatggcccgaagcaagtgaagaatcacaaaagaagtgaaaatggcctgttcctgccttaactgatgacattccaccacaaaagaagtgaaaatggccggtccttgccttaagtgatgacattatcttgtgaaattccttcttctggctcatcctggctcaaaaactcccccactgagcaccctgtgacccccacccctgccccccagagaacaaccccctttgactgcaattttcctttacctacccgaatcttacaaaatggccctaccccatctccctttcctgactctttttcggactcagcctgcctgcacccaggtgaaataaacagccttgttgtgacagtaactttaatggggaagaatgagaagaagatgtgggtaaagaaacaactgtttttctattaatggtggtagtattagtgtgtaattctgagcctggtgcataagtaatatggtgtaacataagtgaatagttgtgtgatattttaattcaatcatcccatgtatttgagaatcagaattttgatgtggtaaaagaagattcacatgtaacatataatctattaaaaagataccctgtagtcatgagtttgacttttaggtatcatttctcagtataacatattgttgtagatttcagataacattttttccccataaatactgtccgctgcaggcctaaaaataatgaaaaggcctaaaagaccaactcagtagcggtaaacaccagtactgcacctagattatggtctttaggaaccattttccagtaaaagataccagtaatctttggaaagcaggatttttttttctttttttttttttttgagatagagtctagcttcgtcgcccaggctggagtgcagtggtgcgatcttggctcactgcaacctctgcctcctgagttcaagccattctctgcctcagcctaccgagtagctgggattacaggtgcctgccaccactactggctaatttttttttgtatttttagtagagacggaatttgaccaccttggccagtctggtcttgaactcctgacctcgtgatccacccgcctcagcctcccaaagtactgagattacaggcatgagccaccacaacccggcggaaagcaggaaattttttaaaagctattttaattcagtcatgtaaaaaaaatgagcagaaagaaacaaaaaacttaaaaaaaaacttaaaaaatgagcagaatcttaggaatcacctgcgactttggttattcatgcttagccatttctataggaaattccagcactatttgagttagaccactaattatatgtgtgttgtagctttctccaagagataatggaattcacaaatcaaaactttgagattattaagtgttacaagtgaattataaccccagtcatttgctttcaaatgaacagctaaacatattttgtgttaatttcttatggatgctgctttgtttgtttgtttgtttattgagacggaatttcactcctgtcacctaggctgaagtgcaatggtgagatctcggctcactgcaacctctgcctcccgggttcaagtgattctcctgcctcagcctcccgagtagctgggattacaggcgtgcaccaccacacctagcagatttttgtatttttaatagagacagggtttcaccatgttggccaggctggtttcgaacttctgacctcaggtgatccacccaccttggtctcccaaaatgctgggattacaggcgtgagccaccattcccggcctagataggcttttagttggtttccatatacagtgtatatagggagaaacagactaagacagacactggcatccacagaagtaaaaataaaaagtaaggtataatttaaatttcacacggtcatggtcacatttttcagctttttgcacctatgttgtataaaaaagacaaaaatgcctttagaggctcaagttttcaggacttcctgaagctgtgtcatagtttaaaaatgccataaaaatgccgtcagatttaataacgtatcagctgaacactggatttctgttatgttgagtcttcaaaaatttctccctgtatgaggaattaatactgttatgtctgatctggtggtctgaaatgtgaacttttctgggccaaccagtaaacagctgctgttgctttatagctgcgtaattcagtcttggaaattattagataattcccacaccatttcagcttgctgttttaccataaatttaatgtgaacagtatttctagctaacctcaagctgtgtttattgtcgtggaattttctcttttattctgaggtaaatgattacaaatggttatgatgaggaatcaaagaagaaagtggactttcttcaaagttctttttctactctagccgcttctgagcatctttctcaagcactgtgtttccatcagtccctaccccaagcagagaaaggaaacagttttcccctttgtcttcagaaccctcttctcatcgtgtcattttccaaagcaaataaaaatcttgagatattgtcttgagtttgattttttttttttttttttgagatggagtttcactctttgttgcccaggctggagtgcaatggcacaatctcagctcaccccaacctccgcctcctgggttcaagtgattctcctgcctaagcctgccaagtagctgggattacaggcatgtgccaccatgcccagctatttttctgtttttagtagagacggggtttctccgtgttggtcaggctggtctcgagctcccgacctcaggtgatccgcgcctcggcctcccaaagtgctgggattacaggcgtgagccaccacaccctgccgagtttgatgttttttttaaccattcaagccagtaaataactttccagacagctgtagtagaaaacagaatttgtgtgtgacaaaacttaagattttgggattgagagctctatggtttatgccatgtggataattgtagccagatgaagaatatgaaatttaaggaagtgtttagagtggtacagacagctattattacgattcttggggtagaagagtagcttacatacaacataaaataatggcattaactgaattaacttcagcctttgccatgaaacccaagctttcattatgttttaaataatgaactacattaaaaatagtatataaatatgtaaaatatattagacatagacttctcataataaattatgggaacttttgatgtatttcttccctaggaaaagaactaaacaagtgcttctttgtggacttaaaatttttcagtttactattgtgaattaggtacagcatatctttataattccagataatacccataaaagcagaactgtttatttacttattatgaagggaatactgaaatgaaattaaggacaatttttttctcacgtattatatttttaaaaagttatttgatgtttgtgattaaataaagaatgaatttttaaagccagttctcaattagcactgaggaaaagaatatgctttttttcaggtacacaaataagcatcatggatataagaaacgacataaagatgaatctacagtctggattaagacgtattttaatttcagtgtcaaaggctgttaggaaatattcagattttagtacttgacaaagaaggttctcaatatttgtttcagtgttcagtgaaaggataaattctgtcgtctttctcttttatcatattagtcactgagtggtttcattaaacattccctcttccatatcccctgataaatttcaacttgttggtgatgcatcccaggagtgtctgtctttttttttttttttttttccttctcctgtcagtgagtcttaggctttggctttgaaaccctatagtgaagggaaatctcaggcaacagctgtgcaaccgtctggagagcagctagtccagattggaggagacgaacgaggctggtcgcaggagagaggcctccaggaaaaaatggcattgatgcattacctgcgttaaagattttcctgtacttagcatgcttcttagggttctactggagcgtttgggaaagatacagtattgatggatgcatagaaaatgaggcaaattttttaaatggggcaaatattaactgtagacaaagaaaagccaaaagtacaaaataacagcgttgtaagatacgaagataaaaatacgcctaagtatgagcgttctggcagactcacaatacagatgccatatatggggtaaaaccataccagtaggatggtgggaagggaaaggggtgggctcatgttccatagtgggaagacctacagcggaaaaatcaggagaatagttatttaagcacagagtttagggagtaagttgcagaagagacaactaaatgagatggccgtgaatgatttttatgacctcctcttgttatggagaaatcgatcaaggaggcctatatttgatggcaggaagaagttgagtttaaggtttccagacatttgttttaatctggaaaatttctttttttctttctttcttttttttttttttttgagacagagtctcactctgtcgcccaggctggagcgcagtggcgcagtcttggctcatcgcagcctccgcctcctgggttcacgccattctcctgtctcagcctcttgagtagctgggactacaggcgcccacaaccacgcccggctaattttttgtatttttagtggagactgggtttcatcgtgttagccaggatggtctccatctcctgatctcgtgatccgcccacctcggcctcccaaagtgccgggattacaggcgtgagccactgcgcccagcctaaaatttcttttaagcttagaagttgcaagtcaagttactgttaaaggcgtcctaactttgaattagataaagctaaactgtggtttaattgagctgagtttgttgtatgctatatctcaacttcacaagatgtttgctttttcttggctataacctaagattatacaaatataaaattacctttatgcccatttgatagactttagggctgaatttccctgtgtaagatgttgtagaggtttgtacttgtgattgtttttactctagaagcatgtttatcttcactcctttagtgacacgtgtttgttcaggaacttcaaactcaatgtgatcaaaactagactcatgttccctgaatagtctctcctgactacaaatctgttggaaacttccaatcctaattaataattgtaaactttttaatgtaagtcatatgaggggttgttgtgagcataggaggtagggagatggtagtgtgagctggagcatatggtaaaagttgtttgaaagaaagtagacccatgatgtggatcctgagggatacgtaaagaaaatgaagaggtgtagatttaaaaatgtttatggggcctgggcgtggtagctcacacctgtaatcccagcactttgggaggccgaggtgggcagatcacctgaggttaggagttggagaccagcctggccaacatagtgaaaccccgtctctactaaaagtacaaaaattagccaggcatggtgatgggcgcctgtaatcccagctactcaggaggctgaggcaggagaatcacttgaaaccgggaagcggagattgcagtgagccgagatcgcgccactgcacgccagcctggatgacaagagcgaaactccgtctcaaaaaaaattaaacaataaataaataaatatattcatggggatgttccagggaaagtagtttgtgttggtagccttgagaaataataatagaaaattagaatagaactaagttggttcattaaagttggaacacttgtagagatttttgatttggacagacattaattcatttgattatttctcttattcgatgtccagaaaaatatctgtacattcaatgtggttttatttgtactgcacatgtcattaataggctaaagttacctctaagatacctgctttcttagtccttgttacgctgtaaattctgggcatcaggatatagctttttattatgttagctcttttaatagatgatacaattggattggggaaaaaactgattatactctggagtaatactttcatagcctgtagtatcctgcaaatagctcctggtcatcttcgaattttactagcaaacttgtagggtaataggttgggacaaagtattataatcagtggctttgagggcctgataagaggaaacaataattgtgcagctatattgtgaataagtagtgcatgatgctgatggttaaccctttcctgcggtgctcaaacattgggaaataattgctttttgttcaaaatgtaagctcttcgataattgagacttttgtcaattcactgaaatattcccagagcttgaacatgtctggtacatagtacatatttaataaatatatagatttaatgaatgaattgaggatgtagccaaatattggaaaaggaaagggaaaagaaagaatagcccaaacattagaaagacagaagatgtggagcagcaatttcacatgcctaaaagaatttctgagattatggcaaaatcatttactttacttactccttattgatcaacaaaggaagagcaggttttatgtaacaaccaagaagtaacatagggatctcagaagagaagaaaccaagtgtctttggatcttaataaaaagaacattcaactccagaaatagggttaaacctatcctacacatgtctagtaaaaagtcagtgtatcagaggcatctgtgtttagagataaaacataccattagattcatttataatagtttcattgtccttagtttttaaggctaatgataaagatttttttttttttgtgagacacagtctctctgtcacccaggctggagtgcagtgacgcaatctctgctcactgcaacctccgcctcccgggttcaagcgattctcttgcctcagccacccaagtagctaggactacaggcacacgccatcatgcctggctaatttttgtatttttagtagagagggggtttcaccatgttgcccacgatggtctcgatctcctgacctcaacagatctgcccgcctcggcctagtgctggaattacaggcgtgagccaccacgcctggccttaagaattaattttcacagaaatctgcttctaaatattattcagtgataatagattttagaaatttcagattcttatgttgtaccttaaaggttaggatactatttataaatgctaaacatgaactcctgtcatcctattttaatgtctttattaagtgattacatgaatgtggcgtttcagtaggtgtttggtgtattaatagatgtaggtactcccctcttaaacctttaagtattttcatgccatgaaaaatttggggggcattctctttatttattgattaggtacctgtattttcaagaatattactcagcttcagttcccccaaatcttttttagtgttaactaccttccgagaacgtggtataacattttaaaatatattttttgaaggtttggatgtcactgaagatccccctatttattggatggtatctttatcagctgggaagataattagtttcccaatgttgctatatttttatgaataggtcctgtagctcttgctttcttgaaagcttagaattgattgtaagccatggactaatgatattctccaagcatatttaacatgaataggctcatgttcagtatgtcaagaagttaccctgttgtactatttaaataatttgagcttagttttctttttccacctttgttctaaattcttaggtgagtctgaattcctgggcatctgtgcacacagcttcttcagtaggtcctttactctcattgtatctgatctttgacttcataaagacccttggcctactgaccctgtatttaatttcacatctcaatagtatttagccttctcatatttttcctcttctttagagctccctgatccctcactccagtcattcaactctgtgtattcctttaacttccaccctcgctctgtctcttcacagatatgcttctttatatggtagtcagaagttcctgtgtgatcttcgtaacctccagttccctccacagtcacctgttatcaggcatctgttccttgagctccagggaatgagctctttgctatcattctggttgtcggactcactgggcactgttgtgtcctccacagtctctcagtggcatcggttgatgggtgcattctccccacactgatgtcattctgctgcttctgattttctttctgctgtcctccattttcctttcaggctcccttccccgtcctccccgcgccaccttttgcaatatttaggattcagaaattccaaatattgcaaaatatttagaatcagaattcagaaattctaaatatcagtgtttaataggagtaccctggggttgtccattttctcacacaacacatacttgctaggagatctcataagtgcagtggtttttcagaggcctgcattgatgattcctgagtcattatgtccaggccaggcctcatacatactatttactggttctctttctgcgggtgctccaccaagaattcagactcaatggaatatttcttctaagatgtacaccagttccttatcaaaaaatggcaaattcagacttcttaggttaaacagagaactcgtgaacatggcatatgtctgttattccatttttctctgttggcttattgctgagtaccatttgggataaaaatctgtttcaggcaaaggataggattgttttcagcttttattaaattctcctagacccttgattttatgcagagaactaattaaatttgaatgaatttaatgtagaaaccctgctattgatgcagaaatcaacctgattctggactagcaccagaatcaactatttttgttgtttttgctttctttttttttgcttttgctttctctgccggtaaataacaactagtatgtaagaatcaaatgaatcaagcataaatccctaggaaatatttatgcattcatttttaacaatttaaagatgtgaagatatataattaagcataatcctctcaaagtttgacgttgaaaagtatttcagatacttcaacttaaatatattttttgcaaaatatcttttttaaaaaaacagatgtggtctcagcaatgtaattattacagtgtgaggagagcttacagttgtaccaaaatttataactaggaagaagagaatgtgaaataatccggaaacctacaaaactgtcctatacaggaataccaattaaacagctactaaaaatgagtgtaaaatgacaatatggctttatcaagtgcttagggtctggaaaaatgcacatattgcctgttatttattgttatacttaatgaatgttcttttgcacgtgagaactgttataaaagatgtcttttgtacatacttggtacaccagttggctttttaacccattagctgttttcccccaaaggtggcctactctagatgacgttaaaaatacacattttccagggacttatataaatagtcaactgccctattatggaaacttaaaagcgaaggccctgaaatatccagacagtttgaacataaaccaaaaatgaagtgaatctctagaattgctgtgtaatagcgtgagtggggagggggtccctcaagagagggaactgacctttttcttcctcgtgggtgaccttgagtacacactttatttagtcattaaaagggtcacctgaagcttagagaatgaagatcctacagcctgttaattttatcattgttagaaactctctgcctttggcctgaaaatggtaaatcacctttcttagaagattctcatatccagatattcttaccaaatcagaatcttttccagcattttcttcaaaaaaccacagttctgggttaaaacacagcagatcctaactgtaattttcctttcatgtacattttagtcatctttataattttaaatgaaagacaggaactacattatttgaaataagggttaaccccctctaattataagcattaatcacacacagttttctcatttctaaatgttaaatataaaatgggagctatctcttcagacacttttctgttgccttctgtgtgcggcaggaccttacttttaagcttagtttgatttaaaggctgagtttctgcttgcttggaatgcttgctcttcaaaatatttgctccctggagagggaaactgaagatggagctttcacgtgactttggattgctgacctggaagacgtttggggtaataggatgggctagggcatggttccactgctttctgtttgagtggggtcaggaaaggaaggcggggctcgctgtgtgcaaacaggaaaacatagtctgaagatgtttgaagcctgagtgcactttcatttgatgccttgctttattgcttaagagaattttaaactgccgaatccgcaaatgtgctgcagcctataatgacacatatttaaatgatttttgcatctaaacaaatgcattcactctttgcctggtgtgtacaatttgaatgacactcgtgctctgcctggaaggaacagacgtttttcattataaaattcagtcaagcagaaaagtagcaaaggaagcagaaatttccatttacatctatgattgaagttgtagtgataaaagaggatgactaagttgaagagtagccttgttctcattctgctatctgacatgggatcttgtcactttggtaatagtttttaaacttacattattgaggaaggctctgatcagaagtctcaaattatacatgttcttcaaccttagatttttctgggtgttttgtttcaaaagtctcaaattatatatgttcttcaaccttagatttttctgggtgttttgtttggttttttggttatctatagatagatttgagtatctctttttttcttaaaatccgttacttactagtaataaagacttaagtggtagctttacgctccattatcacagagattcacagtactttttagtttttacttgtgagcctcagcaggtgtagacagataccttagttgccactgataacatccagttgccactagatcaagaaatggttcaaaattctccaggggcattttctgctaaagaagagttggtgatcttccttttggaagccttaatgtacttaaaccttcttccttagaagtccagaaattcaattatttcagctctctgtggagtgataagtcctgccaaattgatttacaataatgaaactaagccttgtttacaaatctaagtggtgatttctaagtccacagaggcgtggtaacagagagagagattctgatttatctgggggtctatccgtgtttgaacagattgtgtgatttttgaaacatgattcaaaagggatgttgataaattctaaaatacatttttattgaagagcttgatgaatcatgtatacttactttatttgttattctattagatattgtcttcctcatccctaggtggtgttgctagtacagtgacagaattcaaatccttctttttcctctgctctaacagagctttgtgaactcatagcaatattgtaatgcctggtaaaaggtggtgccagtttcaagtactatatcctaattacttcatggctaactcttgttattgttaacaatattgttaactcttttgttaaatgcagtgacatcttttttctttctcattctctgtgtactttttgccctaaatagttctgcatcttttaagatacaagtttgctttttcttggaggtttttatttggaaaatgcctgaaatatatagaccaacatttgttcctccaatggttaaattacattgtctcccaaagtgaggcattttaagtctggactatacccaggagaatctaaaagaggcagttaataagctcttgaagagcacagtggggtggttgtgtatttattgagtctcacacttaggagagaaataggctggaccaaatgagcctgggcatcaaaagcatgtgggtggtcgttggtgatatgtgcagtgatgagtgtgtgtgctgagggtcctagaccaggctggcagggaaatgaactgaaggcagtgaagcctcccctgataactgcagagagtgctgcagcatccaggacctcaggatcatgatgaacaagctgtagtggatggaagggagaggaactatgggaaggatgagtttctggccagaaagtggtttactggagtgctgtgtctgagtattacatgatctgaggaccatgaggtccagctttgggagtatggagagtttgagtggagtagagttatagtcccatggtcttctgattcacagacattcatgagcgataagtatctattgagaaagtggaagcatgatttttatgacctcctcttgttgtggggaaatcgatcaacggggcctatattggttgggttctacaaccaaatagaatgtgttcagcaggagtcatgttttgggctcctcacaatgttcagtgttagttctgttcctttctcttgcttccacataggaaagactttgacccaatgaggaattagtcattgtcctttgggtacacttccggaatttgataatcagttgggcacttgattctagtacatttgctaaaagtaattaataccctgcaattggaagcatgcagcaagcgactgggaatgctaagtgaaaggtcagaattgaaagagtggaggaggctgttgacccttaggcatggatgatatgtctgagtgagaaagcaagaagagtagaagacagagccttactttataatcagaattatgaaaagaggagccaatgagagggaaagaatgattggcttgagatagattggtggaaactggagaagattgaatttaaagaagaaaagtgggccaagttcagtggcccatgcctagaatcccagcaaattgggaggctgaagctaggagagttgcttgaggccaggagtttgagatcagcttgggcaacgtggcgagacccctgtctctacaaaaaataattaaaaaaaaaattagccaggcatgttggcatgtgccggtagtcccggctacttggaaggctgagacaggaaggttgtctgagcccaggaggctgcagtgagctatgatcacagcactgcactccagcctggttgacagagggtatccccgtctctttaaaaaaaaaaaaaaaaagagaatgtggcagagtagtcagagaactggagggctgagaagagactgatggcatttgttgttcttgaccttgaaagaagagttgcagattgttggagcaaggccagatggtaataggttggaaagaacaagtgaggggcgtgagagtgacagtctacaaccccgttaagaagttatctgtgaaaatgcctcttcctgtcttgattatagcctccctcgcacatggctttctgagtatggtatgtgaaaacagcatgctgtatatttttaccttcccatatgagttaaggttttggtaatgacttgtggttcttttgcctcacggaacaccaacctggttggtattttgtcggcaattatgtggtttttaaaaagccccgtatataaccttaattaattgcgtctctaaaatctatcaggctttgagttttttgttttttttttttaaataaggcagaaagaaaggaaagtgttaggagaaagcaaccagtgagaatacctatattttgaagaaacaaagtagggaatttagaattatctctactatatctgctttttcagctcatctctcgggatacagaggactgaactaagctaaagtaggttcaagtctaaaggaaaccttaaattaatttctgtattagaattaatcacacacctataaatacaatttatgatatgagaactgcaacaagagaaatggggggagatgagcagtttgctgatcaatagggttaatgatggtaacatagaatcctagtgatatgcctcccattgactaaaatgtatgcgttaagatagcatagcgcataaaatggtgtactgcagtctcagtgtattcaagcttattatggtttctctgcctaggtttgtgtctttggctttagattttctcccataaccccaacctgtccacattcaagtcactactccttgaaatatattattgatctctaaaatctgatgctaagtctgtcttgcccaacggtggccactagccacccatggccattgaatatttgaaacctggctagtccaaactatgctgtgagtataaaaaacccaccagatattaaaaagttagtctgggagaaaaaaacaaatgtagaatgtcttaatgataattatttacattgattgcatgttgaaatgatgaaatttaggatgtactgggttaaaatatattaataaaattaattttacctgtttctttttacctttttatgttaatgtggctacaggaaattttaaattagatatgtggcctctattatatttctgtgagacaaagctgctccaagctgttttggtccagaactatatctcggttcttttgtatcctacatggacctgcatagaatggtatttagtaatactcagcagtagcagagatgatctcttatcaaattatgttaagttttaatttttattcttgtctctcaccctatgtgcacctctctggccaggaggcatttatcatatcaccttttaatatttggaaatcacttgatctgcttgagtcattgtgttgttttcaaatctagaactctttctaccttattttgtaacttctataattaaacaaaaggcgaaccaggagcagcttggctcttagggatgtgtgaaaaggcgctcagtccttaagttggtgccaaaagtgacaaatctataggatgagatgcaggtttatggaagagaagcatgaaaatttttattttttaaaaggacacagcaagctagtcaccaaaagacagatacttgattctacttatatgcggtacctttttgaatttgaagagtcaaattcaaaaagatggaaaacagaatggtggtttccaggttctggaggtgggggaatggggagtggaggtgggggaatggggagtggaggtgggggaatggggagttgtttaatggtgtgcagggttttagtttagcaagatgaaaacagttctggagatggaaggtagtgatggttgtacaacgatatgaatctacttaacactaaactgtataattaaaagtgggtaagcaaagagtgtcttacaaagcaataacttgtaacttaaaatttttaaaaaccttaatgagattagttgtaatgggttatcttaagtagacccttactgccggaaggaacagctgaatcacatcacttgggagcttgttagaaaagcagactcagtcccaccctagacttgtccaatcaaaacctgcattttaacaaggcccccaggtgattcataggcactgtaaagcttgagaagccctgctccaaatatcatttctcaaagtgtgatccatgagccacctgaagcagagccaccctgggaaggtctgttttcaggcgcgtcccagaacacgtaaatcagatctaggctgtggagctagggagaagatgaatctgcagactgatcaggatcccaggtgattttgaagcatggtttgagtttgaaaacccctaatctggaaagctttaacaactattactcttacaattccatcttttaacgaatgttggaattattaaatacttgtaacaagaagtcctgttattgataaaatcaagatatgactaatagtgcagtcaaaaagaggcaacaaaaaagcacctataacttatcttgggttggttaatgaggaagctgtcattcaaaattagtaagactactgtaacatttcttggggtcctgaacattggaatgagagtcggttttcagagttgagcccacctctgtcattagctttgtgcaaacctcatcaggctcaagattcctcatttgtaaaggggaatgaattctctgaccagttagtttacattcctaagacaaggttaaatttggaaagcaaagaattttcggtatatatgtgataattttgaaattcttgaatttttaaaaaatttaaatgccacattacttatatttttttctaaaaaaaagtcaaaccaagcgctgtctagttattaatagataccacagatgagatgcctgagttggtaagctctttttaattctagttcttttcaactacaataattttatagacttttttttgaaggctagaatgttgatgtggaatcaaataggtatgcctctatgtatggtagatgcacctgacagggatcacttgacttgaacatgccctgacaatgatcctgtgtggcaggtgcacctgattctgagttctgagttaagaaatccgggagtgggccgggcggggtggccggtgcctgtaatcccagcactttgggaggccgaggcaggtggatcatttgaggtcggaagtccaagaccagcctggccaatgtggcaaaaccccgtctctactaaaaatacaaaaaccagctgggcgtggtggcgcaggcctgtagtcccagctactttggaggctgaggcaggagaattgcttgaacccgggaggtggaggttgcagtgagccaagatcacgccagtgcactccagcctgggcgacagaatgagactctgtttcaaacaacagcaacaacaaaacccaaaacaaaaaaacaacaacaaagaaatccaggagtggctaacccagagagccattccttatctgtaaggaacatctgagccctcatctccttctgtggaacatgggcctcgccggggattgagaccctttgttatgagttaagtggaagttgccaggtggagattgttagggggagggtgttaaatgagaatgctgtagagaccacatgccttttgcaagcggctgcggttcctctgtccaacccaccaccactggactctctaccctgtatgcaagcccccagtaaaaccctatgagacatacggttcactagctctgggcctcttctggctcttgaacctggtgccatccacattgcagtcagtaggagtttggcatgacaccttattatgtgaacttttatatcaagccattaaatttttttaaaatagactttatattttacaacagttttaaatttacaggaaaattgagaggatagtccagagagttcccataggctttgcatccagttttccctattgttaacatcttatattaatatggtacatttgttgcagtcagtaaaccaattttgatacatggttattaactaaagtctatactttattcagatgtccttagtttttgtctaatgtcctttctgtgttccaggatgccatccaggaaggcgcattatatttaattgtcaggtctccatagcctcctttcctcttggctatgacagtttctttatacttctctagttttttaataaccttaaaggttttgtattggtcagataatttgtaggattcccctctgtgggaattttctcatgctttgcctggggttattggttttaagaaggaagaccacagaggtaaaatgcccatttcatcacatcatatcaagggtacgtgtttatcaacatgatacagccctgttggcattgaccttgatcacctggctcaggtggtggttgttgagtttctccacttgaaaattactcttcttcccactttatgtgctctactctttggaaggaagtcagtttgcacagcccacaattaaggagcagagaattatgcttcattttcttgagggcagagtatctacataaattatttggaattcttctgcgcaggagatttgtctcttttttcctatttatgtattcattcattcagtcatttagactcatggatatttacattgtactttgatttctaatccagcactacttcataatttttattgctcaaattattccggctttagctattagaagccctttcacttggttcctatgctcatttgacatagcctcttttttttttttcttacaagatgctgcagtctcatcttgcatattttcagccctaatcctagaatcagctgttcctccaaggagcccttgttccttttattggagagtaatgttattggagaatagtattaaaatctggatgttaaggatgctcgttgccactggagtttctttgcttttaagacttctcagttgatagagcaaggcaatgtatttgtccatgttcacccttatgttatgcagatctataaatatttctatagctaactagttgtatttatattaagctataatatctagtctatattaagctaaatacaagttcatccggatgtttcctactctaacgtattaccacatggacactatatctctcctccttggttatgtataaattctcactccatccaccatctatgtacttaattgttcagtttcagtatatgtgcgtagccgtatcagaattgttaacccaggctgggtacagtggctcatgcctgtaatcccaatactttgggaggctgaggcaggtggattgcttgagcccaggaatttgagaccagcctgggcaacatggcataaccccatgtctactaaaaatacaaaaaaattgctggtcatggtagcatgtgcctgtagtcccagctacccgagaagctgaggtgggaggatcacctgagcccaggaagtcaaggctgcagtgagctgtgatcgtgccattgcactccagcctgggagacagagtaagactctttcttaaaaaaataaaaaataaaaaatataaaaaaatttgttaacccacacctatatggatctttttaaaagctgcaagactgctaacaaatatttatttatttatttatttatttatttatttgagacagagtctccctctgtcacccaggctggagtgcaatgacacaatctcagcccactgcaacctctgcttccccggctcaggcgattctcctgccccagcctcccgagtagctaagattacaggcacccgccaccatgcccagctaattttgtatttttagtagagacggggtttcaccatgttagccaggctggtctcgaactcctgacctcaggtgatccacttgcctcggcctcccaaattgctgggattataggtgtgagccaccatgcctggccataaatacttattttgttcccgtggttttttttttcttttctcttttttaaagtaaatcctttgcactatttttattattttaagaccagtgttattcagagcctgggttaaacactattctgtgtgtgtgtgtgtgtgtgtgtgtgtgtttgtttgtttgtttgttttttgagacagagtctcgctctgtcacccatgctggagtgcagtggtgtgatcttggctcactgcaacctccgcctccctggttcgggagattcttcggcctcagcctcccgagtagctgggactataggtgcgcgccaacatgctcagctaatttttgtatttttagtagagacggagtgtcaccatattggccaggctggtttcaaactcctgaccttgtgatccacctcggcctcccaaagtgctgggattacaggcatgagccaccactcccggccagcactattctgtcttatactcactctgccatctgtgtgtgtatatggtacgtatgtgaggctggatctgtgcacttggaaaagttggagagatgatttaggtaaaacttttagttttcacttcttttgcctttttgcttatcttgatccatttagttcctaccatctggcaaatagttctcatctgaagaatcccatctgtcagttctcactattatccggtaatagttacagtgaaatgctggtgacggcaacagccactttttaaaaggatgtgtaattcaccctcatgtcctctttgagaacccagtaactgcccacactctgaagctaaaaccataacagttttatcacatggaaagtttgttgagaaatgtttggctgtttctgtgaagtaatcgtcccgtctcttgagtacagatgcctcccaggaaaattttcccagcctatttgttaatgtgaaagttacaaaagatagcatataatgagcacattcaagacaaaaaaatttgtggagtaagagtctgaaatggtaaaataaaaaatcacttaagaaaacatttatctgtagctgtcattttcatatacacatatctagtgtatacaagttagtaagtacataattctcaaaagttctacctgtctacacatctacacagaaaaattaggaaagtcttgtccagacttttccatcatcttcagtataaagcatcttctagctgttggaatagaaacaagctagattcttgactcctttctatttgattatttagatctgaccttcagacgacatccagaatctgagaacacgcaccacctctactgctctcatcctggtccaagtcattgtcatctcccacctggattaatgccagagcccccttcctggtcttctcacttctagtcttgaccccctagggcaagaataattagcttagaaaaccaccccagagccttccagcattactctgagtactggccagagttggacaatgtttaaggccccgtgcagtcagctgtccctgtcctgtcctggctgtcactcactcgcttgcccactgatctcttccacatcattcctccacgacagcactgatctccttgttcttctgtgagttcaccaggcatgcatctgcctcaagactttgtgtaatacttgttgcttcctctggctagaatattcttccctttgattctgaatactttgttccctcacttcctcaagtcttcactgaaatgtcatattttcaagtaggcattccctgaccaccctatttaaaatttcacccctcagaaaaaacaaacaaaccacccctttctctgctttatctatgtaacatttattaccatccaacagacactgtatttttatctgtattttttatcgcttccccgctaggatcatatatcgttttatctgttttgttcactgctgtattcttagcactgagacataattgtaagtatgcagtgaagagttagtggataaaggacagtggctgcaagaggggatttaggaaacaccccctcccagccaggaccagcactcggtgcaagagttgaaagagttgatcactcagattctctgcttctccagtcgtagggactccaccccgctgtgttgattgctgtcatgtattcaccccatcataagcagtactcacatgtaaaacagtaccatgtcatctctgtggggctacaagtaggtggtgatggtgcaatgaacatataaaaccccagtgtcttcagtaggtgcgaaataggtgattagtgaatgatgaagagtagctgttgctgttttgattactatgattattattatgagaaactactgtggttgatgagatagatactggggagaaggatactattaatataatttattgagcaactttgttctgggcactagttgagtactttagggatattaattcatttaattctcccagttctgccatttactctctatgtgacctggactgttacatagtctctcagtctcaccctctctttttttttttttttttttttttttttttttttgagacggagtctcgctctttcgctcagtctggactgcagtggtgctatcttggctcactgcaacctccacctcccaggttcaagcgattctcctgcctcagcctactgagtagctgggattacaggcatgcaccaccacgcctggctaatttttttgtatttttagtagagacggggtttcaccatattagccagactggtctcgaactcctgaccttgtgatccacccgtctcggcctcccaaagtgctgggattacagacttgagccactgtgcccggcccttgccttctcttataaagtgaaatcattgtagctgctttggtgtggttctgaggacggtgagagaagacgcacgtgaagtattgagggtggtggcaggcacacagttcagagttactaacaatactggtgttttatcttcacaaggcagatctgggcccatagcacaaggaaaccgaggctttggcattttacagtaattacattgccagaacatttcccccactttcttgaatcatctttacctcttgagagatgaggaagagagggcacacctcgggcagaagtccaaagacctcaggcatttttggcctttcattcccatgattctggccaacatcattttagtccccagcagttcatagaaatattgtcttttaatctgatattcaaataatctgtgccttgaagaacctgtgtatggctctagaatcttttacattaatctactcaaccccactctgatgctcaaaacttcagcagtctgttttttttttattttaatgtctttattattatttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgaccttgtgatccgcccgcctcggcctcccaaagtgctgggattacaggcgtgagccaccgcgcccggcctaatgtctttattttaaacatttatttttagaggtagggtctctctaagttatgcaggctggcctcaaattcctgggctcaagtgatcctcccaccacagcctcccaagtagctgggatgacacccccaggtgccgccatcctggcagcagagtcagttttgatacatctttcccttctcattcttcccaatgtcatggattgggaagttactgtggttttagttgcagtactttttactctgaattctgtttgcttcctggaattctgtctgtcttttgaaaagacaacataaagaaatcgaaaaatatactttaaattccatagtgtgggagcctctgctactcgcctgtttgatattcattcccattttttcctttctaaaagaattccagattttttttgttcagggtgacaatgtgctctgctgaaaatactttcacagattcccttgcaggtgcatgtgaccagatcacagtaatggcacatatggcctcagtggaatttgctgaggagtatgtccctcccaagtaacagcaaagctttattagaggaaaaaacaacaacagaaaacctttcacctttgtcttgtttctcctgccttctgtctggaacttggacacagagtcttgaatttctgtgaccataaaacacgaggataaaaccaacgtgctcaggatggcagtacagaaagataggaatacgctggtccctgatggcatcatggaatatctgcagtggccctagcttcagtgtcacttcttaggtgagatacataatcctaccgtgtgtttaagccacggtttgacatgtggtctattctctgccgctgactgcattcccagctgttctatatggcttgctagctaatttaagtctagttttattgtcaaattgaccacattgtagattataatattaaagtacttcacagtctaaaagtgaactacttttgtaaaagccaaaggaaatgggccaaatgaaccattttgaacagagtttaaatgagtgagttgagttaccactcttggatggagaactggagacctggattttcagtctagttcttctgccagttggctctgtgggcaagtcacttgacctgagctcttttcctcccatctgcaaaatgaggtaatttgagctagacagtcctcccaaagaccaccaaagagctagcagattgaggcctgcagactcctattgaatttgccatccttgttcaccttgccaagacttcatagccaagaagccagacccagattttgttcattagctttgaaaacaccctttcagttgggtgtgtgtgtgtgtgtgtgtgtgtgtggtgtgtgacatgcgttttgaatataaattgtgaattgttttagcaagaaaccaggttgtatgtttctcaataaacatgcatactgtatattgatgaatttatccacttgaaataaatggtgccaaattgcctaaagtttgctgtaaacaggaacatgatttctcattatgatgtttaatttgttttagtctttgatctcttacatcagaattctgttaagaactctttttacctgaaagatcaaagcaaataagcagaagcatttataaaaataaggtatacgtggctgtggagagaaactccaggtatatacgatcataggctttttaaaattaataaactttgtttttaaaaacaaagcagtggaagttcacagcaagtttgagtagaaagtacagtttccatgtaactgctgtcctagcaaagatttttaagtacaatattttttaattaaaaagagaaaatataaaccgtgctaagccagttggtgaaaaaggcttcattatacttttagcactcttaacgcttattaaaagtttttaaaaacagatttttgtggttgaatcgcttacaatttctgatgtgtaaccttctaacatgtttcatcaaattttaaaagtaatgtaagcagtgctgtccactgctaaattttattttaatgttagaatacaatgaggtttctattttgccattagtcctgagagcttattaagtaaccagttttaatcctttaaaaaaccattctcattttgagggacacatatttcttagctttgtgcaatataagaagctaagaccatcttggcagtatcaaatgaaatgttttgcaagttagaaagttcagtaaccacttataaacataatgaacaattgttatagtcagtctaatgcagaaatacaggtgttgggggcaggggggtggtgggtgggcagacttggtccacaagtagtagtttgccaacctctgtcctaaacacaagttcaagaatatggttctcttggatagattttctgccagatgaaagtaagagtaacatccttagctaatgaactcctaatatccaaggcaacttttaattaattcaggcttttaagaaaagcttgtttaccaactcctcattaaaaatgttcagactggctggtcgtggtggctcatgtctgtaatcccggcactttgggaggctgaggcaggcagattgcttgagcctaggagttcgagaccagcctgggcaacatatctagaccctgtctctgcaaaaagtgaaataattagctgggcatgatggtgcacagctgtagtcccagctactcaggaggctgaggtgggaggattgcatgacccccggaggtcgaagctgcagtgagccattgatccaaccactacattccagccagggtgacagagtgagaccttgtctgaaaacaaacaaacaaaaagattaatgcagtacatgtccttttggtgaataagtaaatatgttttggtaactttagctttgcattataatctagtcgtcagcagattgactaagggcagataaaacaagatgatttggttttgtggtttggcacttactgtctgatttatgcccccaagaactcttgcaggccaaggtcgagtgtatctgatacctgctctggctcttctcacgaactgatttagtagctttgggccagcattagattttttaaactctttgacctatttgtacatgacaggcatttaatctttccagtagttacttgtcaaatagaaaagcatcacttcttagtttggacatttgcaaatatgactgagcagagctgacagatgaggtgggcatcttcaggccatagggtacttctggcctcctgtaacctagaaaattgggatgcctcagatatcaggtattcttccaagcagctagggttagtccctgacctcagaaaccctgagagccctcagaaaccctgagaaatccacctgggaatggtgtatttgttttggatgagattacctttactttccattctccaggtcttcttgtgttttttgtttttgttttgttttgttttgttttatatcattctatgtaaaagagaaatgtggtatcatttgcattatcatgttatttctttccttataatttatatcttaatgcttatctctggggctaggttataatctcctgagttaggtagccttaggtttcttggcggagattcctcccctgggaagtgaggtttataaaagaacccgtgatgtggccctgtggagctgcatggggtgtgtgctcagtactcactggtttcttccctgcaaagtgacacctgcagcctttggggtaccatgtctcataatttttgcattccctgcaacacacactatactgctatgggcatcattgatcattttaaagatttaaggaatgacaagatacagtgcttattctcccctatgatttgcttagatttttatctaaatagtacttattgaaataagtacttcagtatcatgctacatcttacatgtttgagctagaaacagactaaagtttaaacccttttatgagaatgaaaagttacttccttccccttcttagggcttttaatccctctttatgttgcatttcagaaaatgccctatagcgtactatgaaagaaagacattcattcctgtctttgctgctgtgtggacgatctgtattccttgctccgtgggagttgtgggtttatgtctattcttgcatgttttgcctgaaggaccacagtgacctacttggtggtctccctgctttcatggtttcactatgctgatctatccttcacttaattatagagtctatcttaaaaaaaaaaaaaaaaaaaaaaaaacttttggcctatgttgcttcttccaaaatggcatccaaaacctaagcctctttaaaattggagtccagcatgcttccccagtgctacttccttctggactccctttgccacttgctttctgcttccacccatatccagatgggctgcaaatatgccttgctggttctttactctgtctttgcacaggaggctccctcattttgaagggtcttttgctacccatccatccatccatttggattctataatagagttcttgatgtttgacagaactaggccaggaattgtgggggtataatggcaagcaagacagagtctatccttacgttatggaagttcaattcatttcccatgtggcatactacttctcaccattcagattcatctcgaatattgtttcttctttgaggtttttcccactgcacccaagatactggcctgacactttccttatctctattacagaatttaacttgttcattcattaacagatatttattgcctactatgtgcaagaatctgtgctaaaagctgggaatattgcagtaaacaaaaattaagtttacagcttacatataatgtggtaattatccatcttttaccttcattagactgagttcatgtaggactttatgtaatatctttatatcttcaataccagaaatgcctagaaataatttgcataatatacattttctttaaagatttaacaaaagtctgagggacagttttcagaataaactgaattaaactctctctctcttatgtgtgttatgtaaacatatatataaaatacacttttgggttttttgcttaggaagtagaaaaatgctaaaatttctgttacttacaagcagattaaaatgtccaagaaagaaaagtagggatttatattgattctgctcaaatgcttacctagacaatgtcaatatttatattttactcccctgttgtagtagaatggtaattggttctctagttaagcagcttttttaggattaattttgaagcaagaaattcagattaattaagggacaatttcacttgcagcatttaggcattattttaaccatcaaacttgaagtggcaagaaacggagttgcttaaggaggccagacgtaacattctaaaggtagtagggtcttgattgggttgcttaggcattaaaaggctgtttaacttgtcttgaagtctatctttccttgatgtcttctgcggtaagaacactgtgatacagatggaatgacgggaagtggttttcctttctttcagttggtgagtttgtaagtgatgcccttctcgttcctgacaagtgcaaattcttacaccaggagaggatggatgtttgcgaaactcatcttcactggcacaccgtcgccaaagaggtaccagcccataaattctttcttattgcaaagtgaagatttcctggggacgtgcttaatggcattttaggggtattttgaggcaacagctatgttgataagttatttaagaaaaaaacccagtgctactatccgtaacccagattttagtttttagagtgattttaggttcacagcaaaatcgaacagaaaatagagttcccgtgtaccccctgtccccacacatgcgcagcctccccatccatgaatatttttaaaaagtcaaaaatagggccagttgaactagattcattatgtgcctgtgccgtgtttcgcaacttaaaaatataagttgtctgtgccatgccttataacttaaaaatataatctctaatagttataactttaaagtttacccttcagattatttttatgcacctgttgttttcttttgtcatatacaattttttaataatttagccttttcccctgttatctattagtgaatacagtggtagaacagtgaagtagcttttttataccagcctgaaagctccagttagaattcagtttctcagttataccatccagttttatattcagcaggccatgcctaccatcttgatttttccacagggtgagtctgaccgagcacttggttaacctctgcttttggctaagccaataaaagatgtaagatacttagcatgaaaaggtcactgtgtggtaagaccaccttcacagctgctgtgtccccttgataggtttcctaataaatttatataggtttatttgtggcaagatcagtcttaggctaactagaattaggctcctttatctagctcatagtgcttcacttgagtcaattttgatcccctgtccctcaccggaacatgtctggagacattttttgttattacagcttgagggagtggtgttactggcatctgatagtgcccagaggccagagattctgctaaacatcctacagtcaacaggataaccacccgccacccccaagaattaggcagtccaaaacatcaatagtgctggggttgagaaatctgatctagcttagcttaaccattgtatcatagctttatagctgttagacagaaaataccactgaagatttagtattattttatgcctcttataaaatagtatatttggatccactgtagaataaaatgttttttatgtaaaaatgtgttttggaggtttaagagcttgctgagtttaagaaaacaaaccaaataatttgaagtccagctacctatttgataacctcattttttattccttctgtgttttcaaaagaaaaatcctttgtctctaagaaacggaaatgactcccataaggtcaaaatacagtctgtaatattttcattgtctacctttatgtcttgaattattcatccttcatttatcactagtggatgctctcagaactttatgctaatctagatttgtgcaaatttagcaaatcccagaaaagcaaaaagacattcaaggagaaatctctaatgactgtaagttctgattcttagtggctgcaggggataatttcttctcttcccaggattgttactctgaaagtgaaccaagagagtcagaatttctaggataaggcaggtccatgtgagataaacttccatctgtaagggaggtaggagtgagctggggatctacctggaatgcgcacaatttctggatacacgaattaagccagaaggcattaattctctggtatctgttcaccagtggagactgctacatcttatttcccaattagtttccattccagttgttcgtataaacctctattatataacatcgtggtcttattaaataaataataaacaagaataaaaagagtaccaaagtgtaacccatgctaaaaaaaatcctgttgtaaattcactcaaaaagcaaataatcttttcctttgtgaaattggttcctaatatattgggtctgcatgttgattattttatgtggagttttcttacaatgaaacacatctactctaccactcactgttttctccttacactttgtagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggaggtaaggtggcctttgtgttcagcctcagagatgctgaaacatcttgtatggagtatttgtatcctgtaaattaatctttctgtttatcactgaaaaggtctctgcccactcccatcagagtctgctgttatgcaaaaatctgaactatgaatttttatggcatcctgttgaattaataatatcagtcacccatcacagagttaattttaactatttaatattaaacttgggatcaaaatcccactgataactatcataggttactggtagttctaacagggagttgaaataataatggcgttctgttttggtcattaatttaaaaatatttttaaatgctctctgggattgtcagtcattagtttaaggtgaattttcgttaaaggtttggtttgagattttgggcgttctctgtgtggatgtgtaagggtttttttttggccttttatcatttcttttccttcatagtggaagtcaaaggcattaataaatgcttgttaattttttttaactacctttgatttgttgattgtaaagaaacctattttcgcctctttttcttagggagcttagtcccgttacttcttacctgattctcattcttaactgaaggcaaacatctatattcaaatcataaaattataaaatgagaatctttgggttggaaatgccatctggttcaggcattgattttatgctgtctcatcccccgaagggtgatgattgtatcacttatcttattccttcagtattctcttagatgttccctagagctacagatttccaaacagcacattcaataggagttgtaagtttataatcggcaaactacaggatgcttgtttttttttcttttaatttctggtgtaatctgctactagggcccccatagagtttattgtctatatcagctagaacactgggaccacagtcataaactgaaggatccaggcaaactgggtcatatggttacccccaccaattacagtcttcagtgatgatgtcactatccaggttgatattcagttgaaatgctagccagctccttcctagttaccttcatttacatcccatttcagtacctgaacacagtcatgctttagactctgaaattccttagaaatagtaccataaggtttatagctttgatattcctctctgatcatgatcttccctcataatcacctccccagttcaggcttttagtccattatcctctttttccctgcctgcctttctaatcaggatggaatcaatggataaccattcttacctattccattgaacatccttgacttggctgaaacccttcacattttctaaacatatttttgtcaattctccatagctaggaaaaattaatttctttctttagttgcttctgggatttctaaagtatcaagtcatgtaaccttaccacttaattccatttcttattcatgctgtaacatcagctgggatcttaatgttactagatgcacctaattatctctgtcttgatgacctatcatcttccccatagcagttgatccagcccaacttcattctccttggttcccagcgtaactctctctcatgctctacagatgacccctccaccgtcatccattgtgaatttctgcaacatggtacctgacatttggtaggtgcccagtacgtgtttgttgaataaaccattgaattttctcctgtacttcagcaactcttgtaccttcttctatccctttgtttcctgtcttcccttttatgattatgttctgctggactctcaatcatctcctctccctttcttgcattttcagtctccctctcccccacacccccaggcttcatccaccctcctcccagataattctttcccatgtgttactatctttctactatgtgtttttaatcctgttgacagttggtaggaaatatttgatggtttattctacctgtagaaaagtccaaattctcttgcagggcattcagaagtctcttacatggcttcagcctgcattttcagccttatacatgtatgtgactctcctggcatcctaaaaccattgaccttttctttctctaggctttcattcccaccgttctgccccatctgaaatatttttcctttttttgtcaaatggggttaatgtatgataaagatatttgtcaactctaaagtgccacttcttatgacccgtcaaaatctatatatttataaatgttcacctgaaaagatgcagcctttacaagtctttacaggtgccttgctctgctatactacccttgctttacctttttcttataagaccataacttatcttccaattaattgtagtcatatctctttttatctgttagaatccaaactatagtttatgtgtctggtatgtcttgcacataggtcctcaataaatattagacaaagtaaattgtatattttaaattttttttcatagcttttggtaaggacttcatggtccacgattggatattgtagaaagcttatccagcccactgcccaggacgactttgaatgcggaccaacacaaattcataaactttcttaaaacattatgaaatttttttgcctttttttttctataggccctgttatagagcctcccatcttttagcaaagaactgtctaatacaaatgtaatgtgagccacatactttttcgttttctttttttaagatggagtctcgctctgtcacccaggctggagtgcagtggcgtgatctcggctcactgcaacctccacctcccgggttcaagcgattctcctgcctcagcctcctaagtagctgggattacagacatgtgccagcatgcccagctaatttttttttttttgtacttttagtagaggtggggtttcaccatgttggccgggctgatctcgaactcctgacctcgtcatccaccaacctcagcctcccaaagtgctgggattacaggcttgagccaccgtgcctggccttactttttcattttctaatagacagtttaaaaatagtaaaaagaaacaggtgaatttaattttaacaacattttatttaatccagtatatctgaaatatcatgtgaccaatatgaaaaatttaataagatagttcacattctttttttatgtttctttctttcgtaagaagtcttaacacttcttttaacatttaacagcacgtctcaattcatactagccacacactgtgtttgatagttacatgtggctggtgactactatatttggacagtgtagttcctggatgacttgaaatttcttatcactctttatttttccattaagacagacggtttgtataacctagtaatgttttctaaggctgagccactgaatttttattattgtttttaactattcttgtttttaaaatttaaaaaaattggtttggattcagtataattagtatatcaggtcacttgcaccattttattttttaacttcttttcctgtagccctgcaggcgggcagggcttctttcatgtggacaaaaccagaaaggtgttgcatcactgatccacacacaaggtgggctcctgccaactggcagcctccttgttccaggaaccagccctccttttgacacttgaaatgtaaaatcagaatagaagtttaacgtacctgacttaaaacatcttcaggggatgctacgtgacaattcttgaagaaggagaaacgagctaccattttcctggaaacaatatttgattcacagtattttgttgtttggtagttaatgaggcttgttttgatagaagatgagtgtttttctatcgctaatggggcatttagagaaacattccttgtaggatgagctctgttttatgacctcattgaaaaagaggtatgaaaaagaggtaaatctttaacataggcaaaacaggtagtgtttcagaaatttatgtgtaaattaccgagtatatttttctccagtgttgtaatggtcatattctcagatcacctcaaaatacctatttatgcagtctgtaatgtagcataatccagactgttactaacattatgtagcataatgttaataataataattacgtacataatgttaataatacacagactccagccatcgtgggtaagatttttttccatgggaaaattcatttggaaagctaacttgtaagactagccaggtaggcagcctagccctggaggcagagctgctcctcacctggaactgcagaatctgattgaacccagtggtccatgggggttgctgaattcgtaaagcaaatgaaatgttagaagaccctctaattgttgtagagtcacacttttcctcttgcagaggaggtactcacattttttttaagaaacaatctttaattatcgatgtattcttttaggtttaggtttgcagacactggtgagcgtgtgctgagaggtaacttgatgtatctttctggataattagatgattttttttttctatttctttgaacattttttttttaaagagctgcttaagatctggaggagtgattccttttgaccgtgtcttattttcattaagactgtataacttggaagagtttttttttttctttttctttttcttttttttttaagatgaagtttttgctcttgttgcccaggctggagtacagtggtgtgatcttggctcactgcaacctctgcctcctgggttcaaacgattctcctgactcagcttcccgagtaattgggattacaggtgttcaccaccacacccagctaatttttgtatttttagtagagacagggtttcaccatgttggccaggttagttaatgttactctctggtttggggggcagtgatatgttttggcttttttcccacccagatctcttcttgaattcccatgtgttgtggaagggactcggtgggaggcaattgaatcatgggggcaagtctttcccatgctgttcctgtgaagtgaataagtctcacgagatctgatggttttaaaaagaggggttcccctgcacaagttctctctctttgcctgctgccatacatgtaagacatgacttgctcctccttgccttccaccgtgattgtgaggcttccccagccatgtggaactgtaagtccagttaaacctctttcttctgtaaattacccagtctcaggtatgcctttatcggcaacatgcaaatgaactaatacagctcggggtggcttgtgtgggtgcgtatggccatgtatgcaggtgtgcgtgcattggaatatacaattccgtattgaacccagtttaaacttcatcagttctggtgattgctggagtgtcacatatggcaagacgtcaccttgccctctaactacaccagaaaaccaggccagcaccattgactatctagatacagtgggccgtttatattattattgtttcatatttttagattatttggtaaacaatttacagaactaagaataaaggaatagtgagaaataactattagcaattttaataagagttaacatagtaaatattttaattttacgaagaatttaaatatggtaaacccacatgtttattctgtattttcccagttttgaaggtatggatttctgaaatgagcattatcctttggaatgcagctagctgctaatcacctgccatgcacgaacctgaaatatatccgtcttacaaatactggttctacatttcaaatacatctctattaggttcatcatatttcttggtcttttttttttatacttgcaatttcatttaattattgtaaaaatttaagatatttaaaacattgacagctcataattttattgaagagagaatatagccatcttccctcaggaataaaatgttttcaagtttggatttgtaaacagctattaaaatgatcaagccagtctttttttccccctttttttctgcattatctcttctaatcaccttagagagattcctgccttgggcatttgtccacttcctaatggtatcaaataaatgtgttgcacagacataaaatgtgttgcataagcatcataaaatggcaaggaatactgtcacatcattttagcaatgatggttaatgtttttgtcacataatattgagtgatgatatccttcctgttgaatgactaagtggatgagaataccatatttcctttttattcttagaaatacattgctcagccgggcgcagtagctcacgcctgtaatcccagcactttgggaggccgaggtgggccgatcgcctgaggttgggagttcgagaccagcctgaccaacatggagaaagcccatccctactaaaaatacaaaattagctaggcgtggtggcgcatgcctgtaatcccagctactcgggaggctgaggcaggagaatcaattgaaccagggaggcagaggttgcagtgagccaagattgcaccatcacactccagcctgggcaataagagcgaaactccacctcaaaaaagaaagaaagaaagaaagaaatacattgctcacttgtcaattcttgagcttgagaaaattcatctaggatatcatgtgaaggctcatagcctaaggttttacttacgtgatcaatttcattcttcttctggtttatctaattggtaaaatgcctccttctgtcagttgttcctatttgccaatatgtggaagatgatttttgactatattcagtgagtctccagacttctttttatcatgctttttaaagagatgggacctcactctgttgcccagacttgagcgcagtggctattcactggtgtgagtatggtgcattacagctgcaaactcctgggctcaagtgatcctcatgcctcaacatcccaagtagctgggactatgcagactttttttaaaccatcttgaaagatgatgcagtactttgggaacacagcaataaaaatgtgataatttccctattgcatcacctttctaggcaattatatcattctttcatgctcatattattttgtcttctttagcacagtttttaaatagttgatggctaatgatgaaataattcttcggatgataaatattttgtaacataggaacacaatataggaaaaagatcgaggttcataccatatctcagactcatggttaagtacaagctagaatgagttttagtcgattaaatttctttttctctatgaatggataaagtgagaatatcagcccacaagtagttagaagtgctcagaactcaaaggtaaaattgtgtccaagacctgatggtattctaaaggttaacagcctatcctacttaccaagaatttacatttattatgaggcctgtacaacctgatgcaggaaaatacttggcataattttctataagttaggtagttaggtgctcaacaagtatttgagttgaatcacattggcattcacatcaaacacatacacctacgtcatcatgttaacttaaggttaatagtgtcaccaaaactaactggtctttaaaaaagaaaaactaggccaggcatggtggctcatgcctgtaatcccagcactttgggaggccgaggctggcagatctcttgatgtcaggagttcaagaccagcctggccaacatggaaaaaccccctctctactaaaaatacaaaatagccaggcatggtggcatgtgcctgtaatcccagctactggggagactgccagagaatcgcttgaacccaggaggtggaggttgcagtgagctgagatcgcaccactgcacttcagcctgggcaacagagcaagactctgtctcaaaaaaaaaagaaaagaaaagaaaagaaaaactaaggaatatcattctagacatgcagtaattaagtaaaattgcatcaggagtctaataacatagcatgatgggtcccatgtttcattatttccatgggcagaagagggatggctacattataaataaaggaaaattgtaagaataagaaaagatgaagtatgaaatatttccaactcaaaaacaaactgtatctgagcatgcagaggtacaaaatgtcacctttttcctccagtgtaatgaagggcactaaacctcttgagcatttgatatgttccagatactatattaaagtgatttttttttttaggagacaggttcttgctgtcacacatgctggagtgcagtattgcaaccatagatcagtgtaaccttgaactcctgggctcaagtgatcctcctgcctcagcctcccaaatggctaagactacaaacacattgccaccatgcctgcctaatttattttgatttatttattttttttgtagagacaggggtctcactatgttgcccagactgttttcaaactcctggcctcaagtgatcctcctgcctgggcctcccaaagtgttgagattacaggcatgagccaccacgccagaccaaggggtgaaatcttgataacaataatcaatgcagtcatcataaaacgcttgcacaggctcaatttgtaggtggcacagtgctacatctagtcaaaagcaaatttaattatggtcattgtgctctgagaacttttctcagaaaataataaccagatggtattatagatggtgcatttcacaaatacatgatttgtagttagtgaaaacttgtcattcaatcatgtaataaattatgcacatgccgtcttccacttagctagtgatgttgaaacattcatagccttacctgatgagctcaggctgtcatgagaatttatgtctattcagtactttgtctttaaaattaggtgagagagaaagagaggctgtatttgactatatatctttttatttgtatctctggagttacaagtttttgaatatataatctttcagctgcctttctgcattgcattttgagaaatgatattaaatgctcaaggaaaaaaaacctaacaactttagagggccgcaaagtgaatcatacaaaagataaattaaagctttaaatctttgccagtggatgagtcaagtaagagtggatttaatgaaatggctcatggctttgagaagcagctgtcataatgctgggttggcagcttccaggactgtgtgaggctttctgactgtctatactgaaataggagaactcatttgaaaatgacgaataggagaatagcagaaacttgcattttcttttgagggaactggctgccagttttgaggtccttatttagaaatgctcgattcctgtattgaataaacttggactacatgtatgtcaaaaagaaaagcaaaacacttttatagccttaagcagattacagatgtgtggccaaaccagtggggtctgtttttgtttccaagcaggtgatggctggaagaggagatgcctctgtagtgcagggcttgagttgctgctgtctgagctacatctggcaatgagactgtgctgcttactgagacctaatggcacaggttgccccagtaacaggatattgctgaatgagaaatactgtaggattcatttgtaagagttatttggagggttggattattcagtgctaaggatcctaagctactgatgcatggactcttttcttccctccagtatcttttaattaaactgtacaaattccctggcttaaaaatagtaggaaaagaggaagaaaatacagattcttatgattttaactggtctctggcaatagtacaccgaaacattaatttcttgttgaaaccatctggatatttgtatcttcagtgtaaaacccctaatttagataggactctccattgtgacatggaaaaataaccctttaattagttaattaattttactgtggcctcaaaatctacatattagcatatcaagccaaaaactgttggctttacttgggagccatgtggcttaaactagtaccagtaacttaccacaaggaactcagcaaaattataagtccatgtttgttttggaaggaaggcaattattacgaaaataatttagagatgttcaaactatttcctttgagtagaggtagagagtgaacaaaatctgtcccaagtgggagctaactagcttccttttttgccctccctgtttacaaagtaacacttttagtttactaggtaacatttgcagtatccccagtgtttcaatgtaaaattgtaggtggtagactaatgccacttagccaaagccatgatcacctgaatttttaatatatatttttgtatggagtgagatactgggagaacagtcttcattagcttaaactctagaatgtactgtttgtttgtttgtttgtttgtttgttttgagatagagtctcgctctgtcacccaggctgcagtgcaatggtgcaatctcagctcactgcaacctcccctcccaagttcaagtggtactcctgcctcagtctcccgaggattacaggtgcctgcttccacactcagctttttttttttttttttaatggagacggagtctcactctgttgcccaggctggagtgcagtggtgtgatttgggctcactgcaacctctgcctcccaggttcaagcgattctcctgccttagcctcccgagtcgctgggattacaggtgccaaccaccatgcctggctaatttttgtatttttagtagagacgaggtttcaccatgttggtcaggctggtctcgaattcctgacctcaagtgatccactggcctcggcctcccaaagtgctgggattacaggcataagctaccatgcccagccaagaatgtacaatatttttaaagaaatgcggtttattaccataaaatacaggttgagcatccctaatccaaaatctgaaatgccctaaaatccaaaatgttttgagcactgacatgacagcaaacgtagaaaattatgtgactttatgtgttcaatgtatacaaacttcctttctgaaacaaaaattatttaaaatgttgtataaaattgccttcaggctgtgtgtataaggtatttttgaaacataaatgaattttatgtttatacttgggtcccatctccaacatatcttatatgtatggaaatatcccaaaatttgaaaaaaatctgaaatctgaaacacttctggtcccaggcagtttggataaggattactcaatctgtaaatacagtagctcaaattgattttgtaaggcagtcaagttattatttatagtattttaatttgtattattcttttaatatagcaattcattttatatatttatataaataaattttttgcaattgagcaaattaaaaaaattaagtgcttccttcagatctacattttattttctatttgttatcaatttaataagtaaaggacacacagatcatctgattgtgttgtcagacatttgaaggtgcaactgatgaatgttcactgttgtactttgttttgtcatgtaaattgttttaaagagaagtgaatgttgagcatatagtaggccacacgtgcctgtggattggctcattgttttaggaatgtgtaattctggaaaagatttgccaagggtattcaaaagtatagtttgatattagaaattatttgaaaataatctttatagcatagcaccattttatttagatcaatagtaattcaagcagtatacataatttgctattgtaagcgtagcatataacctaagttttcttttacatttgagaccactgtttgctgttggtcgaatttggtcttccaagattttttgcttagtgacctaattgccagcctttgtgaagagctgttacttattgtcaaaccaggcagtaagggtttgcttttatctttttatcagttctttcaatgctagtagtcatgagattaatgtagttggatactaaaatgttaatacgtgttagataacaaactgggaaagagatgaatgacatcatgaaggaaagggcagtattgcacttacagtgatttcatgatgatagaactaacctgcctaaaaagacattgggtggaaacagaaaccaggtgtaatagacgcatccaagtagtcaaggaaagaaaagacttgtaagtaaataagataatctttgcttcaaaaatatcttcaaaggtttaaaatgtgctttaccctcatatataatctttttgagcctatttctttacctcaaacatggggaaaattgcaataatctgtatcacggtatttgcttccaaaacgactaattggtgtaaatgcatatcaagccggtaaagtttacagtggacttgtttaaaatgcgtagattggaattgttgggggagcaggccagcagcatgggatgttttttttgtttgtttgtttgtttaagactctgtcgcccagactggagtgcagtggcacaatctcggctcactgcaacctccgtctcctgagttcaagcaattctcctacctcagcctcccaagtagctgggattacgggtgcctgccaccacgcccagctagtttttacatttttagtagagacagggtatcaccacgttggccagactggtctcgaactcctgacctcaggtgatccgcctgcctcgggctcccaaagtgctgggattacaggcgtgagacaccgcgccagctggggtgatttttttcttagtcaaatcacttctctacccatcatctcacactgtcgaatacaaagactctccttggggctcaatgactcatctcccacctctggtttgataatcatggctattataacatgttccctttttaattagttattttaaaattattgtaggtcttgtaatcataatcaataataatacgtaatggctccttaagcacttctatcctagataaggttgagaacattattaaaattagttttggtagtaatcaagtaatgataattcttatttatgaatttaaatatgtaggagtttttttattttagggaagcaaaaaggactagaaagtatgatgtctcatgattagaaaactgctataaaaatgaaggtagaattgatttgggctgttttggacattttaaatagaaatttaaataggtattcaaatagcaaagtcattctactttaaaacttctatacttttttaggatcttcaattttatatttaaattatatttttgaaatggttttagaagaaatattgtatcttaaactctaactactaataagtaagagaagatatatcaaaggtttgatcttttatctcctagaatatactattcattcgtttcccattgtacgtcatttgaatgttaatggttagcctcaaatggttttcaacataattgtatagctactattattggaaaattggagccaaggactcatacacatatcagaagtggtaatgaagcactttggttttatgaaaatatgtttacaaggtagtcacaggatagcaatattgcatttactgtaatacaatgatggtggaactaagtgcagtggaacaggatgctgagaccacagttaccgcatctctaagtgcctcgtctagttatggtccaacctcagatataactcattggtgttgaaacacacctagcaacattttaagcatagaccgttcattaaaaggtacctttttaaaaatttttatttttaaaaattgacatgtaataattgtacacatttacagggtacacagtgatcagatcagactgatcagcatattcatctcaggcatgtatcatttctttgtgttgggaaaattcaatatcctgcttctagctgtttgagattatgtcatatattactgttaactgtagtcatcctacagtgctgtagagcactagaacttattcctcttatctagctgtaatttggtatcctttaacaaatctttctctatcctcagtttctacctacccttcccagcctccatcatcctctgttctactctttacgtctatgaaatcaacattttctagcttctgcatatgagagcatgtggtgtttaactttctgtttttggcttatttcacttaacatatgtcctccagttccatccatgttgcttcaaatgacaggattttattcttttgtatggcttaatagtatttcattatacgtgcatgcacgcacggacacacacacatacacacacacacacacatcacattttcttcatccattagtctctttggacatctaggttattccatatcttggctattgtgagtagtgctgcagtaaatatgggagtgcagatacctcttttaatatactgatttctcttcctttagataaatgcccagtagtgggattgctggatcgtatggtagctctatttttagttttttgaggaatctccatactatcctcaaatggttgtactagaacagagcttttttaccttccttccatttgggaatcttcttacccaacatgtatattagtaacttggctatgtatgttccattctctgtctcaaatactgtgtctaggacatctgcaatctttggctatgaccacgactgtaaagtgcatgacgcttttgctctgtcatcagtattagttgacaggcaagtaagatagtacttctcttcataacccctttacctgcccagcagaataccagtacagacagacccagaatatctctgggctcaagaatccagacatttataggatgggacttttatctataaatcaccttaagattagtaagttcttagaattggttacctttgccatttctcagaagccctttgtctagtaacctgtgtgtcactgtcatttccagcctgtctttcctacacattgtttatgcaggctttaggagtgcccaccccccagttctaccccccacccccaccctagcctttgtggttttaattatcctgtcttggctgattttgttttgttttgacatttcatccattaaattcctgacactggctatctctttacaattattatactatttttctttctggctcgctcttcctgattgctgtaatccatgcccttgactttaaataccatttgtaagtagactaggccaaggtttatttctctaggccagactctacctagttatttcataggcatatgaatcctaacatgtccaaatgagagttcttaattcccctgctacccagtcctcaatgtggttctctcaaagctattctatctcagtaatggtcctatgccctctcctagggattattgctgagaacctagaactcatcatcgtctcttctgcacatcctatgaattctggatttatccacttatctccatcttttccagcactaatctaaactcccattgtttcttgctggagttatttccgtatcctgctaatctctgctctcgttctctctccctgacacatgcgctgctttcttctcccacaccaagccattctctgtacagcagccaggatgtagagtgtttatttacataaagcagatcctggaacccccaaatttaagttgtgttcgtggcttaccaatacgcttaaaaaccaagtgcacagagagaaaacaatgaagccttatttggatatgctgaggataattgataacgggtaacaactaacaaacacgtagttggtgtcaggtttgacctcctacattccttacaggtattagtgtatttgacccagctcctccctacctccgcagtatcaccccatgcctctctttcccccgactctcccctgctcagtgtcacacaagtcaatatccccagcttgctaacccccgggctgacagatctcattgtctataatggatgttccaaggtcccaccttcagcctcagttttgttgccatctttccagaatgaattcccttgatcattctgttttttggagacaaggtcctgctctgtcacctaggctggagtgcagtggcatgatcatggctcactgtagccttgacctccctggctctggagatcctcctgagtagctgggactacaggctgcacctggctaatttttttttaatttttagtggagacaagatctcactttgttgcccaggcttgtctcaaactcctgaactcaagcagtcctcccacctccgtctcccagagtgctagaattacaggcatgagccaccatgcctggccctgatcattcttttctgaagaaaacaccccttcttcattattctcaatcctagcagcctatttacttccattctgaaatgaatcacattttagtattttattggttcgttgtcgttctctccccccatagaatgtaatctctctgagtacagggagcttatctttttcccttttggagcctcggatccagcagaatgccagacacttagcagccactagcatttgatgagtgaatggcttttcatacacaattttagacattgttcctgattggtctctctagtcaataatagatttatcaaatctaatcgataatagatttctttttcttttctttttttctttttctttttctttttttttttgagaagtcttgctctgtcgcccaggctggagtgcagtggcatgatcttggctcactgcaggctctgcctcccaggttcacgccattctcctgcctcagcctcccaagtaactgggactataggcgcccgccaccatgcccagctattttttgtgttttagtagagatggggtttcactgtgttagccaggatggtctcgatctcctgtcctcaagatccgcccgcctcagcctcccagagtgctgggattacaggcctgagccaccgtgcctggccgatagtagatttcttttattgattagagagactaatcagcaacaatgttttaaaattctcacatagatctctgaatgggaaagcagtcttgaattatgcttgcagggagagagaggggaaggaaggaggaggaatggtataattagacttcataaggctagattttgtttctacttaaataatggtatcacagtgggacatattatccatgcagaaagtgagtgggcatctggtctattatctgtggtctttcaggaatggcagctctttagtttaaaaaacaacaaagtgcagcactgtttatttaatggaaatagaaaagcagtgcctgtgtattagtggctcagatttttttgttctttgttttcagctgtctgctgtatgcctctccagcggggtcttacagaatctcaagtctaccatgatcaaagctgaacccattagctccatttcttaattcctcctgtatcctctgttaccattagtaactattctccaactcaaagcatcagattcctcctcttactcactcccttcatccccagtcaccagttctgtgctgttattttatccaagttctcagtaggcttcacgagcaccgccttcacatcccaactgtcgctcctccacctatctgtcctccatgcttctgctagctcatgtttgttgcaatacaactaaccttgccactcttctgcttcaggcttttctactaggctctgcatctagatgatggtccagactcctcagcctgtgaaacaaagcccttcataaaagagcagagctacagctagtcagctcccttcctgcagtccaccccctcctccaccatactgagaattggcaattcctgtagcactctttgtatgagtccattttcacactgctataaagatataaccaagactgggtagtttataaaggaaagaggtttaattgactcacagttctgcatggctgaggaggcctcaggaaacttacaatcatggcagaaggggaagcaaacacatccttcttcataaggcggcaggaaagagaagagcgaggagcagagtgggaacagccccttataaaactgtcagatctcctgagaactccctcactgtcacgagaacagcatggggaaaccactcccatgatccaattccgtcccaccaggtctttctctagacacatggggattatgaggattacaattcaagatgagatttgagtgaggacacagccaaaccatatcactcttcatctgctacgggtgccattccctgtttctacagtgtcctgtttgctaccttctttgtagatttctattcattcatcatgtcccagtttacctgttacctcttcaacagattattcttcagtctgtccctcccaaactccaccaatgaacattctttgttcagcccattattgttaatatgcacttcactgaaaacactgttttatgcttgtttacatcccatctctgcagggctctgagcctatagtcagcagttgggaacttactaggcatagcgcccagtaaaggatagctctttatatatatatatatattttttttttttctaaaataataagccccaagaaaaacattacctgtgaaaaacaaatgatatttttataccattttcaaaacctaatagcaataaaaagaaaagaaatgtcataagtatacatttaagctgtagttaaaaacagtaaataggcacagtatttaactcttatcatgtgctgttccaagtgtgttatttacatcattggctgttcacaccatcccctgaggtggttaatatttccatcccatgttaaagatgaggaaaccaagtcacagcagcctaagtgacatgttcatagtcacattggagctggcaggtggcagcactgagaatgaaacccacgtggctgagctctggaaagtcaccattaatcaccacactagaccttctctctaggatctacataactagaacatacaattaactggagtatatgtaagtgtagtcgttccttgagaaaggaaaagaattcacaaatttcatagcctcatcccttgtgcatttgtggcattgtgctaggggtgtctatttgatatttgaccctacagatttctcagatgccaaccaaccacagatactttaaaaaaagatacttaatacttaccaatgcaagaaagtgggcttgttggaagaggaaaaatgttagctcactaatggaaaatcaactaaaagtcttacctctccagaacatgcttttcctaaatgttgtggctaacccaagaagctacatcatctttacctttatgatacaatttaaagtacttttctacttacttcaagccctcagagcacagaggcaagggaggccttgggctataaaccctgtagcctgagccacatggcttcttctcctggacagatacctggcatattctgccactgaggatcagtggtgcagatgtatctgttttctcctaggaatggggctccacttacgaatctggggcaggacaaggtattgctgcattttggggagcgtgctggaaggaggagcagagtttgttgtttttgcttcctgatatggactggctgtgtctccattcaaatatcaacttcaattatatctcccagaattcccacatgttgtggagggacccaggggaggtaattgattcatgggggctgatcttctctgtactattcttgcgataatgaataagtctcacaagatctcatgggtttatcaggggtttctgcttttgcttcttcctcatttttctcttgccttttcctcatttttctcttgccgccaccatgtaagaaatgcctttcacctcccgccatgattctgaggcctccccagccatgtggaactgtaagtcccattaaacctctttttctccccaatcttgggtatgtctttatcagcagcatgaaaacagactgatacacttccttaacagaaccaattattttttcccaaaaaagagggggagaagcccagaagcatgcagcttctctcttctttctaaggaataggtcttcacaaagtgcccccaaaagaaaaggaccaggcttttctcttactttgtgactttcctaggttgctttgtagccattttggacacagaccacctatagctgtgtagtagttctcatgtgtatggacacagtggaaggagatgccaggcacatagttcttgctgcattgacaccttttcagggcatcttcttttaccatcttctgtagaaactgcaacagcccggccaactaccagccccagcccacccctagctttgctgctttcattttctctgtaacacttgtcaccttgtaatgtgctagtgtaacatcgttgttttagttttcttatatctttccttccctgtagaatgtaaataccaggaaggcagggaattttgtctgctttattctctgcagcatccctagactccagagcagaccctggaactcaaatatttgttagacagccaaaggtcatatacttccaactctccacccaaaatatatatggatcacccatccttagtagcagctaaacctttggacatgaggaatttgctcgttcacagttttctggcctagcatctgattaaccaaactttttcacatatcaagaatttaaaatgactccaaaactttttatgaccttaggtgcttctccttaattctagttggttcataaagctgtcagaacaataatctgcttttgataatatatgacttttcttgcctccaagatagcctttaaaaaagcaatttagccttttactgtaattatattccaaatttaagtcttgccagaatatcattttccccctttaaacatactttttatgatgccaagatattttaaagaaaagttcagataggaagcatatttaagatgtcagtatatgtctctaaaatctaagaacatttttctacagagtccagatgataccatctcacccacaaaattaacataaatttttagtaccattggataccatgtccatattcagattctccctgagttccagaaaggtccttcacaggttatgcatttcacatcctatccggcaccagggccagcatcttacatccttaattcttaggattcagaatagcactttttatatcctgacactgacttgctgaagaagctgtaccagttttcctataaactgtccactccttggatttgtcttatatcatgtcccaggggtattgtttagattgttgctctattgctaggatattcatgttaccctaagtgtgtactgagatagcagagtaaagagagattgtcttttaaaggttctgcccaggaactgctggtttacacaaaagctgggctttagtgcttctcggatctctttgcttgtttcagtaatttttttttagaaattcactaattcactaacgtaagtggggcagggtttacaggagcatgtgttgagagaagttggtttgactttaaatggtcatttttacaatccgtatttaggccttacaggtcgcatacaatctctgtcacatattgctgtcatttttaccccctttcttttctttttataatcctttaaaaaatgcaaagcccacccttagctcacaggatgtacaagaacaagttgcgggttgcagtttgccaagacctgctctgtgccactgctgacttgccattcttggagcccactttctgttcttgtcagccaattccctttcaggtgctcaggtttccctccctcctgtcaccgggcctttgcacatgctctacccaccctgcctagtggagagctatctttggcccctggacttcattcacttcggaccttctttgggtcacatttcagtcatgcctcactagacacctggaatctctgcctcactagacacactagcactcactcttttgggtcttctggctgtatgtaattgttatcagggcagtaattttgcatttatacaggtgctgaggtcagtgtctggcctttggctacttgccttgtgagccacctttgctttccagtgtacccctagctcctggcccagtgtccagcttcccagcatccattcatgttttccctggagaccattctgtgcccagcagccagagacatcattgcaacttaaatctcattgagtcgttccagttgctgtaagaaatgtaaccgtactgggtaacactatgcctgtctgtctccaccaccagatcttatacttcctccctcatctgctactccctaagctcactggccctttgttgtttttgctgaacgtgctaatctcttcctcacacctgggcctttgcacttgctcttacccctgcctcagccatccatgcactctcttggttttgccgtgcccgacttcagcatttttagttcacatggctcttccgtggggcccttccctgaccaccctgtttgaaatgctacccatccctggcacacatctatcatagtcattcattagcaattagccccatctcctttccctatagtacttttccataattttttttcttgctcatattacacctccccaactaatagatagattccaagaaattgagtgctttatcttcactacctggaatagtactggcacttggtaaagcacagcgaatattgttgattgaattactaggggttggcttagagaggtacttaatggaatgattcaatggatgaatgaatgaatgcattgccacttttttgctcattatcatcaatttgtacatatgcctttcaactcaaatatttatccattggctaaagaaaaaaaatacctgaatccccgtgtctctgcagtttacccttcctcactgttaaaactcagtgcctgtgtaaaatttcattatattttatttacttcttattccacttgtgcattatgtggatattcctgcctcatccccacagccacctatcacttccggccaactcagatgcctctggctcgcaacaatcacttctctgttgaatttctgaagcgtttaatctgcagtatgtctgttactcatacagcagttagtgtgaattgtctcactcagaataagtattcattaaatgtgtaagaatgatgatatagcctaatttcagatcaagattgtgatttatagctcattcttaatcagctgtgtcatgactttatttatttattccttttttttttttttttgagacagagtctcactctgtcacccaggctggagtgcaatgcagcttctgcctcctgagttcaagtgattctcatgcctcagcctcccaagtagctgggattacaggcgtgcacccccacgtccagctaattttttgtatttttagtagagacggaatttcactatgttggccaggctggtctcgaactcctggccccaagtgatctgcctgcctcggccccgcaacgtgctgggattacaggcatgagccacctcctcaggcctgagtcatgaatttttggtagtccagtcatgtggttatcttcctaaagctggaggccttaaacctagggccccaggtgggcttatgcctttagctgcaagtaacaagaaacccttttcaacctttttactgatttatttagagagaagtacacataagaggtaatgcaagtaagcaaagttttttaagaccacacaactagatagccagcatccggaccagaacacagagacttgctggcccctagaatcctctctcctggcccctgccagttactggcctttcccctgagttctatttgcctgcagtttgcttgttttcatatttaattcaaatagaattaggtgatgtgtccccttgtgtttcgcttctaacagtgcctttatgcgggagaagtactggctatttcttactttgccctccctccccggaaacattttcctaatttagtagcagtaatttcaaaaactgctttcctttcggacaaactgacttatccagccattgtaccttccagtttagactctggcagtttggagagttgagacagagagaaggagaaccgtctgtttatcttcttgaaaaaaactactgtattttctctctcttctgactctgggagcctctagactcttttttcccattttcatatccacagaggaagagtctgaacctcttcctgctgagctttcccctggttggttgcatttcaggaactgacattggttgtcttccctcttccctcatcagtgcaagtaggttggatctcatgatagtccatattcacataaccatgagaatcagagctttctctctgtcatttcctccctgtttatctgtagcaagaagaaaaaagtccgtcttaacagagactgtgaaagaataaatatagactttattgttttagagcagttttaggttcacagcaaaattaggcagaaggtactgagattctcccatatactccctgttcatacacttgcacagcctctcccattatcagcgtcccccttagagcgatttgttacaatcagtgaacctacactgacaccattattatcacccaaagtccatagtttacattagcattctctcagcattgtttattctgtgagtttggaaaactgtctaatgacatgtacccaccattgtagtgtcatactgagtacttttactatcccccaaatcctctgtgttcctcctgttcgaccctctcttgcctttaacctttccaagccactgatctgttactgtctataattttgccatttctagaatgtcatatggctttcttagaaaatacaaatggtgacttttttggcatgactttaataaacagaaatgaaaattggtgtgtgaatcaaaatctttcactctgtaaagggacttatcaggcggcacctgcatgtggaattatatcaaggtcagctttagttagaaacagaaggagagtcacctttgtgatgtcatttctccttcatccaagtaaaatctcgcatgctgacacataaaattttatcatcagtgatttatttcctcgtaggaatgtccctttgaccttattaaattcagatactctggggatggtcagcattttcagatggttcccttgttctgtaaaaatgtttgttattggtgtttaaaagctgtaaaagccacccactataaattgatagccactaaagtctgcgaatgtggtatgaatgttccactatgttgccaagcgtttattttattgtgagttgttatttgattgtttgtaaggaaattgttttatgatgctcagctttatatttccataaactgttcctcccttgcaactccttaaactgtgatgagcttttcaaaacaagtccacaggacaacagtctgtccagcatttgaagaagtggtggaaaagtcatttttttcctttcagtgtttctagctgttcatgaaaactgcagttaaaagttgtaatgttgttgtgtttggcattctttgggaagatgcagcattattcaaacaaaaccgtgtgctcttgttttaaatagtgtccaaatgaataattgaattcatggacatctaaatttaattccagaaatcaaagctatggtaataagaacttggacctgagttctcttaggccaagtaatttaattccttagccggttgaactatttattacgtgtctccgttcctggttattatgccagtaaattgctcaggcagatgcagggatggatgatgggcatataattcactctttttcacggctagacacataccagaatgcagatcacactaaacagctgtttttacaaacatggtttctattcagagctttaagggccacatccaagtaataacaaagaagcctggagaaggaacctggggatacccagggtcatgttttcaccatcccacctggaaacacggtgctgtccaaaccctggatggtacacttggacatcgtcattccagtcatggttcaagatcacgtgtatacatcatgatttaaagagaatactggtttgatttttcttcctgactttccctgaattttccacttaaattggaaaacagcgctagttagtgcccatgatttgattgaataagtaagagatctcaaacacggtaaattaactgatgacatgcatcaggtcatctttctttgattcaccagtaatacaacagtgagatcctacagaaaaatgcaaaggcagaagctcagggcagctgagcaactgttaaggattcttttgaaatgtagccccacgtagtaaactttcgtgcaataatttgggcagtcaaaaaaaaaagtcagttatttcacctcatttatttctacgaggagataaaggcttccaacatctgattttcagtgccagtgttttctgtttctcttttcacctatttcgtcctagtcttgtggaaatgttacaataactgattaggattttctctgtattaacacttcatttattaacatatgagtaagttgctattaataaattattctgcttaatcagtttctttttattctttagccacatgctaaacttcttcggatgtcttcacttaatatccttacatcatatttaatcagagttagaaaggcgttccacttgggggtcatacacatttttttgaaacttttataaacgccctttatactattcttgtatcctacgtaatcagagtcaggtgttccatggggatcatacacatctttatacaacttgtgtaacacatgctttaaatcctgaggtaatcagagaattcctgccattgatggattaatctctttacatatctttccctttcactctcagcaaaactacttatggcggtcctgttagactttgaaagcctttcaggtttatggaggagtcttcctttctattgtcgtagatcatggaatcatagtgttcgcttgtctcacgtgtttggaatctgatttcctacataatgctgtgctctcactacgagtccaaggcttcctgtggctacaaatcccgggttcctatcacttttcccaatgatgagcttctccttgttggccagaatcagctctgtggtaataattcccttctgctttctccctctcgcttttttttttccttctgggtacattataatgtcagcatagcagcttttaattctattactatggtacttctcgaatagacctgtggtagttgccccagaaaggttgaaaccccctgccacatctaggtctttctcctgtattggttttgtgatctgatcaaggacatctattcctctagtcctgctaggtggtatacgataggcttttactattagatattcaaatgctgtcaaccatgcctgccttgacaggtacatgatttccacaaggatttcctaataggcctttttaattttgttctagacatgcccttcttttgccatccaaatttgcttattttttacaaactatgatgcatcagcatgtaaatgtttaataccataaatatttctgatcctcttcccaatttcactgagttactggttatctcttgccattattctcagcatattgcagtggatctcagaatattttcccctgaccaccagcatcagtattacctgggaatttgaaatgcacattctcaggccccaccaaggcctcatgattcagaaactctggagctgcattagaaactgccacaggcacctggtgatctgtgttggtttttgtttgtttttaaggagacagtgtctttgtctccctggctggaatgcagtgatgcagtcatagctcacagcagcctcgaactcctgggctcaagcaatcctcccgccccagccttctgagtagctggaactacaggtgcacaccaccatgcctggctggtttttgtttgtttttaaggaggcagtgtctttgtctccctagctggaatgcagtgatgcagtcatagctcacagcagcctcgaactcctgggctcaagcaatcctcccgccccagccttctgagtagctggaactacaggtgcacaccaccatgcctggcttttttttttttttttttttaatttttttggagacagggtctcaccgtgtggcccaggctggtctcaaactcctggcctctaggttttttcccacctcagccttccacagtgctgggattacaggcatgagccaccacatttagcaggtaggtgatctgtgtttcaataagccttccaggtgattctgatgctcactgaaatttgagaaccactgaaatatttggttttctacaaaacataagcagttagtaaccatagggtacgcaactaaatagttccagcaggcatccctgaccacagggcattgcagatttacttaagtcagtttcatcttccacctgtgtgagttccagcaggcatccctgaccacagggcattgcaggtttacttaagtcagtttcatcttccacctgtgtgagttccagcaggcatccctgaccacagggcattgcaggtttacttaagtcagtttcatcttccacctgtgtgagttccagcaggcatccctgaccacagggcattgcaggtttacttaagtcagcttcatcttccacctgtgtgtccagtttaagctctcagttgcagtttttaaaccaatttccaccagcatatactgagtatccgctaccgtgcaatgcgttgcggctcttgtatgtgcactatgagaagtaattcccataatacggcaaactcagttttgatatccaccaccccactttttataatggactacatttttcagagcagttttaggtttacaaagaattcaagcagaaactacaaaaagttccctctacctctcacttccccactccccaacagtttcccctggattaacattttgccttagtatggtacgtttgaaccaatatcgatacactattattaaccagtattcctgttttaacatgagaggcgactttttgtgtagtatagtctcttggttttgacaaatgcttaatgctgtgtatctattattacttatgacagtatcgtgcagagtagtttctaaaaatcctctctactccacctattcatcccttccccactccccctgaaccactggcaaccgctgatctttttattgtctccgtaattttcccttttccagaatgtcctgtggttagactcatggcatccccttttagcaactgcagaaactaagaactgtccccaaggataaaaatttttgcagacccactgagctgggatttatacttagacctgctgaattgaagttttgggtgtgtttcttctcaaattgccaaaattccatatggacgacttttcttttccttccctgaaatgtgtttaattgactttttctgttatttgtgtttgccttcacagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgaggtaatccaccatttgcttggattccccccacccccaaggaaaagaaagcgtaataccagagttggaaatatccaccctagcaccactgccttccccaatcaaaaacatgtttttttttccaaaaggcttcttatgcttgtgaaatttttttggtttaacaagcaaacaatttcaaataatgtgaaatctttattatacagtttgttttgtaccttgtatatgctgcttggcaaatcccaagttaattctacaagactccgcccaaccaggtagtcatctaatttgacaaacactgagttaggtgactccttggtattcctttggcagtgagtgtttgttatataatattgtctgttaccacctagacgatgagctccttgagggtaaggacttgattttattcagtattgcacagagtgcctggcttgtagtttcgataaatcttagttgagtgagtagttgtgattagatttcattaaagaaggagatttgggccaggcacagtgcctcacacctgtaatcccagcactttgggaggccgaggcaggcggatcacctgaggccaggagttcaagaccagtctggccaacatggtgaaaacccatctctactaaaaatacaaaaatgagccaggcgtggtggcacgcacctgtaatcccagctatttgggaggctgagacaggagaattgcttgaacccaggaggcggaggttgcagtgagctgagatcacaccattgcactccagcctgggtgacagagcaagattgtctcaaaaaaaaaaaaaaaaaaaaagatttggtgagtatcgcattattttatgctatgaattttaacagaggtgatttatgttgagtttacattgttttattgggaagtacggcagtgctttcttcaagaagtaaatatagtattaatgtcttagactttctctattgaattaatgtttgtgttgcaaatattgtgaactaaaagaactaaaggtcatacttgtctccatgaaataaaaacaaacattcagttgatattaaatgaccaaatgttacagaaacgagtaaactgttggattgagttccttaaagagtatgcatttgttccttaaagagttctgcatttcatatctgccatctgcttggcagatagtaaaagatgcttctagagctagattgaatgaatatgtacttactgaattttaatgtactgcaaatacttataaaggtcaaccacaaatgttacagcatttacaaaaagtggctttctctcactttttgctaaagtttaatgatttcagatttattgttctattagagcttaacatgggctattttgtctccctcaactatattcatagttgtcactatagtattttcttccctttgttgcattttttaccttattaaggtgtaatttacatataagtttcatttgcttttaagtatataattcagcggctttaagaaatttgccaagctgtgcaactatcaccataatctaatcttagaacattttcgtcactccagtaagatcacacatactcactcccagttaagccctctactcacctctagccccaagcaacaactaatctactttctgtctctatagatttgcccttttttggactgttattataagtgggatcatataatacatggtcttttgtgtccgacttctttcacttaacacagtatttttgaggttctacatttctttaacttgagcttttaaaattgagattattctgaattaaacactcagcgttagcttaaaatttattgaaagttttacatgttctttgaaaaaaaagaacagagtgcaagatggattaagtttatcattccctacttaatgacagtttcttactcactttagcacataagtaaatgtgctagtaaatgcgcattttgtttaaaccaccatttttcaaatactgagacatgctttctcagggtgtttttcatacaactgttaggaccaactatggcagatctggtcaaatgaacttgttagcctgatgcctgtagcagggaaggacagcttttcagggcttctcttctcgaaacctaaatgaagtgtgaatacaaattacagcagctagcagcctgcagtgggactgaaagtccttggtgaatctccatcaagctgggctgtttaatagaaccagtttagtgtcccattttacttgaaacattagattttgagcacctgcttggtacaagccattttgctaggccatgtggaatggatgatgagcacacacagaccagctaaccctagtggatgttaaaatctcttaggaaatagaagtcaaagaagtacaaagccatctgtgttgtaagaaatgtgaacacagaacctgcctccgagagtaagagggaacttctggattgatcagagaaggttccatggagagcatgacatttgaactagagccaaaagtgtgggtgggtggtgtgtctaccagtggattttgctgtagagtcatcaggactagcaaaacaaatgtggtgccatggaaaggcatatttaggagacaggattggtccaatttaagctagagcagatgtcttttaggttgggaccaaaatatagagaccttcaatgccaggctggcaaagatgggcattaactgcaggtgattaattaacaaatattaattcagaagctactgtgcgctgcagatttttccaggagacaataaagagattttgttttgatgctagtactgttgaggtaacaggtgaacaaggagtgacatcagttatgcagtacaatgagaggatgccacataaacttaggcccatattctagaacaagacaatttgcttgagataaattggtctcattatcgtctgcattagtccagttctttttgcttgagttttgcaggtagtattatttgatattaagacggaacacagagatgttgtattgttttatttcctgtagaaagacgaaggcagttaaaagaatttcataaacaaaacactccaggctaaaggcaaaaaagaaatgaaccttaaaaaataacaagttaataattttgttggcaagaagagcaacaaaagcaaccttctgaaagcaagatacctggtcattgagagatagcaactgttaatgccccagaaatagaggaatctttaatgcaggtccattcattccacctcaaactcctgaacaaaagctctaattgaggcaagtcttcctgggaaagggggcctaacagaaacatgttatggtcagttgtgcccatgcgagataatttttttgtgcttgtagctaattccagtaaagaagtagatgttttagagggtaacgttaaaggggtcagctgcaaagagtccttttcctcctcctcactgttacaaaaggtgacttgtggttcttccctaattgagagcaatggcaacgccataggtgattactcattttgtaaaactctaattacaagtaggttgcttctgtgttcaacataaaaattagaagtgacttgcaaagatgagatactgcagggaggcttacaatcttgttttcagtgttagtgtttcagtacctggaacaaaatgtgatttacagccatcctttctaagaaaattgtcatcattaccaacatattgctactgataccagtccttaatgtgcttcataaaaaactcaataatttcataacccgttaaaaccggaaagaaatggagggaagaaaaataagacacttttagcgtagtcataatcttctctgccatattgtgttagaatcgatgatacccaaatgagaagatgtctgttctctgtcactgattccagtagaataaaattattgtttaaaagtaagcacatccgctgcactccagcctgggcaacagagtgggaccctgtctcaaaaaaataaaaataaaagtgagcacacgattgcaagatctatctggttttgggggcttattgtcatctttggttgttaaaaaaatacttggatattattggttattggtctagtggaataagccattaccgatttgagtacaacagtggtgtatttagatacttgctcctaattttctgttcttcaagaagggattgtacttcagaaaccagagatatcagggtagttttgattgagccataaattctaaattctgattgaaatgggtattgtaataaatggcataatcttttatttaatctagccaattgtgccctgtccagaggaactggacatttcttccttatgttccatttattcagcaactattcgttgtacccctgctgatggctaggctctttgctactgtggaaggcatcgttggggcagagcagacagcattttacctcctgggagactggcagatttttgaagcctttgttgcagatatagattttcacggtcaccactcttgccctttaatgtaatttaaatttttttttttttttttttgacacgggattttgctatgtttcctaggctggattcaaactcctgagttcaaacctcagcctcccaagtagccgggaaaacaggcctcttgtgctttaaagcagtgattctctgtctttaaaccttgtaactatgctgtgtggtggaaattttacttccccgtttaaagccaagatctctaaggccaagaattttttttttttttttttttgagatacagtctcgctctgtcacccaggctggagtgtagtggtgcgatcttggctcactgcaagctcggcctcccgggttcacaccattctcccgcttcagcctcccgagtagctgggactacaggtgcctgccacgatgcccggctaatttttttgtatttttagtagagtcagggtttcaccatgttagccaggatggtctcgatttcctgacctcatgatctgcccaccttggcggcaccccccgccccccgccccccgccccccacaaagtgctgggaatacaggccaccatgcgtggccgaaaaaaatttttttaattggcctgggctgggcgcaatggctcatgcctataatcccagcaccttgggaggccgaggcaggcggataacgaggtcaggagattaaggccatcctggctaacacggtgaaaccccatctgtactaaagatacaaaaattagccaggtgtggtggcatgcgcctgtaatcctagctacacaggaggctgaggcaggagaatcgcttgaacctaggaggcggaggttgcagtgagctgagattgtgccactgcactccagcctgggcaacagagcgaaacttcgtctcaaaaaaagaataaaataaattgtcctgggtcacataactggttaagtgatgaaatcagaatttggacctagataggccaggatatttctgctacactcatgtcaaaattacactttttattttctttataaatacacacaaattcatttcaacctgtgttcccttgtaaatgcatatacctttgatataggcatatattcatctattattttacactgtgcatttctgaatttttagaatttttacttgaagtgatcaggctggcgctgtggctcacgcctgtaatcccagcactttgggaggctgaggtgagcagatcacctgaggtcaggagttagagaccagcctggccaacatggtgaaaccccgtcttcactaaaaatacaaaaaaattagctaggcatggtggcgcgtgcccataatcccagctactcaggtggccaaggcaggggaattgcttggacctgggatgcggaggttgcagtgagctgagattgcgccactgcactccagcctggcgacaagagcgagactccgtctcaaaaaaaaaaaatagaaaaatgatcgggggtccacaaataagagtaatgatcaagggtcagcaaattggggccaaaaatagcctgttttcctgttttctacacaaaagttttattaggcacagcccatcccatttgtttaaaaattgtctatggatgttttcatgttttggaagtagagttgaggatcgcaaaagagattgtgttgcctgcaaaactgaaaacatttactatctggccttttcagtaaaccatttgctaacccctgattctcactataagacggtgactgtgaagttctttctatttcacatactgccatatcaagttgatttcttttgaggtagggtttgtttttttttggttagagatagactagtatagtgtttgagagaatttttatgaccttgggccagttaagtaacctgttttttatgtgtgtagtgtagatggtaatgttatcttgcatgtttcttgtaagaatgactttaggtaacttatgttaaacgcttaccatcatgcccagtaagtgttcaatttacaaactcaagctgtccagattcaaatctttgccttacaagctactaactgtgtaaatttgtataaatcaaataaccttgaatcctcattgcttctttttgtaaaatagggattaataagacctatccaatatttaactattttgtgaggattaaattaattaatttataggaaacactttgcataattcctggtatacagtaactgctcaattaaccttagttgctctcttagttatggttatatcatcattccgatcctccattgcatttgaaacattagcaaactaatgtttactactaatgaggaatgttaaaggtaaaccaataagttgacttttaattataaaaggcataaatgtaacctatccatatctattggtataataaagctgatatttagagagaacattatgttatgattaaaagaaacatttcttgcttaaattttttttgtgtgaatatacactgtatattgaaatatctgcacttaaattttaaatccagctgaaaattggataagatagtattagatgccactgcatttcaagatagagttttatttcttgcaggtattttaagccttgtgggagttcttctgttaagtgaacagatagagacactgatacagatggctctttcaccgtctcatgtgatgataaaagctaaaaggtttgatccgaatattgcttatattgggctaagtgattgaccttggcagaattaaattatttttcttcttctggtgacaattaatctgggagaagtaccatttgatttattgctatacatttcaccaatatccacaaggcacttgtaggtaccagacatggcattggttgctgggggcacagagataggaacaaagtggcttgctcaggttgcttctagccatatctgcattgtccttgagagggatgagtctctcaggcctgcctaggaaggaattttggcagcatggagaagagaaagtgctcagcccggaacaaaagttttcacctactatgttgcagagaagttggcgtatcagtaattataaaggaagaatagggatttactgggtgatagagcaccaaatagaatgaatgcaatacatacttgaagtaaatcagagtagcttgtattgatctcaaggggagaagaaacaaagcttagcttaattctcatgcctctgttgttacttgtttgtaatggacatgacacttacaaggtatcctataattcactaacgggatttttacttatgattaatatttaactctccacaaagcttggggtaaactgtgaacttaacttgctgtgaacccgaacatgaactcacatacttcagttggaggcctcagtagtagcatgctgtacaaaaatgaaactaaagctccagggagtatttgggaacagggcaaaagggtaatggctcctccttatagagcaagcctcaggcctttacctttgtgttttgaagatggagaggatgcacttctactctcgcccgggttgtagcatgcttgctaatgatgtcaagagaactagtgtcagcactgaccatagatgtgacaggtaacagcctgttattttgtgccccatgtcatggcagccattgattccgaggtgtttgatacacactttgatagaggcagagtgaagcaggacatggacaagcatctttccgtgtagtttaatggtctcaatctagaaagcccactcagataattaggttgcttaaaatgtgatgagactagggaatagagccatatagaagtgtgtgtgagagagaattcagtggtttagtatattcacaaagatacacatttgacaccagcctgggcaacatagtgagaacctggctttaccaattaaaaaaaaatagaatagcagaagtaatcagtgaaaggcattttaatacaattatatctagatttattaaaaataaaattttagtccaatttaattaaaggccagaaactagatttttaaagaatattagtctttctcatattttccccaaatcagttgctttaaaaaaaaaaaagtgtgcagatgcctcaggcacaataactgtactcaactcaagaatttgcaattaagaaaaaaaaaaatcaaacctcaaagaagaaatccagcaactcagaggttcaggttcatttaaacatgcatacatttacatgggcacactttttttgttttgttttgtttttaagatggagtttttgtttgtcgcccaggctggagtgcaatggcgcgatctcggctcactgcaacctctgcctcccgggttcaagtgagtctcctctctcagcctcctgagtagctgggattacaggcgcacacaaccgcgcctggctaactgttgtatttttagtagagacaggttttcaccatgttggccaggctggtcttgaactcctgacctcaggtgatccacctgccttggcctcctaaagtgctagcattacaggtgtgagccactgcaccagctgggtgcacctttttgtttgtttgttttgttttgttttgttttgttttgttttgttttgttgacatggagtctcagtcacccaggctgggattcagtggcacgatcttggctcactgcaacctccgtctcccaggttcaagcaattctcaattctcctgcctcagcttcccaagtagctgggactacaggtgtgtgcaaccacacctggctaatttttgtatttttggtagagatgggtttcaccacgttggccagactggtctcgaacttctgacctcaggtgattcacccaccttggcctcccaaagtgctgggttactggtttgagccaccacacccaaccgggcacacgtttttagccaagccataggtctgattaagtacagtcagattccttgagcaggttacaaagctgtggatttgaatggagatctttagttcccttgcagaacaatgagtttccaaaagcagagtggcttacagcctaaccagctgcttctctcagcctttaaccattttgccctcctgaaaattcatctttggtttccaaccacctcttccaatatgcctgactttttgtgattctgttagtagaagagtaaaaagtcaaggggaggcaagaatgaatgaatctcatataaaaatgatgctcaagagaatcccttaattttcaagacagcagcccaaattgtaaacattgagacttttacagtgttaaaaaaaaaaaagtgtttacaggccaggcatggtatctcacacctgttatcccagcactttgggaagctgaggcaggatgatcgcctgaccccaggagtttgcaagcagcctgggccccatagggagaccaaaaaaaaaaattgttgttttggctgtagtgtcacaggcttatagtcccagctactcaggaggctgaggtgggagggtcgctggagcccaggtgaggtcaagcctgcagtgagccgtgatcacaccaccacactccagccttggtgacagtgagaccctgtccaaaaaaaaaaaagattaaggcagaggaaatgttaaaggttacgctatatttagttgataataatggtaagactgttcaggtgttttaactatgagagtagggttgcctctttcttaaatttatatatgttcttattgggtataatttctagacagaatatgcaagtatcacagaatatggatggcaattttatgttgcttgcacgtgactttaggttcttatgtttcatgataggagcaaagaaaagtcttgcttgccaattcttatgattgcatctgttctggaaatttactagcatttgttacccaggatttctgaagtgctggtgactgctgcccagtagtcttggtgggcaaagttactaaaatgcatcacgaatccttctggtgtttgcttgggctatggcagggtttctggaccttagtactattgatgttttgggccagataattgttgcggatgattgtcctgtgcattgtaggatgtttagctgcatcactagcctctactcgatgccagcagcacccccaagtgatgacaatcaaaaatgtcccctgggaggagtaggggatagactctctctggttgcaaaacactgggctatggtgttgagatctgcagtgatgagcagctttagatatgtgaacagaagcccaggcgtggtggctcacacttgtaaccccagcactttgggaggctgaggtgggcggattacttgagatcaggagtttgaggccaacctggccaacatggtgaaaccccgtctctactaaaaatataaaaattagccgggcatgatgatgggtgcctataatcccagctacttgggaggctgaggcaaagaaatcacttgaacctgggaggttgaggttgcagtgagctgagatcgtgccattgcactccagtctcggcagacagactgagatgccgtctcaaaaataaataaataaaaataaaaaagtgaacagagaaatacccgtgcaatactgtgtctcatcccccaaagacggagtcttgctgtcgcccaggctggagtgcagtgacacgatctcagttcactgcaatctctgcctccatggttcaagcgattcacctgcctctgtctccgagtacctgggattacaggtgtgcctcaccaagaccagctaagttttgtgtgttttttttgttttgttgttttttgcttttttttttttttttttttttgagacgaagtctcactctgtcacccaggctggaaggcagtggcacagtcttggctcactgcaacctctgctgcccaggttcaagcgattctcttgcctcagcctcccaagtagctgggattacaggcacctgccactgcgcccggctaatatattttttttttttgtagttttagtagagacagggtttcaccatgttagccaggctgatcttgaactgctgacctcaagtgatccatccatctcggcctcccaaagtgctgggtttacaggcatgagccaccaagcccggctggtctcattttaatgtaagctctaacttctgtatcactgctttgcacattgtagataaccagtgaacattttttattgtataagaaaaagtaaaataaacaaaaatatgccaaagcaaatatgataaatacacatttagtaaggtaaaagcaagtatttgataaaatgtgtaatgtagtctagtagctttatttagaaacagaaaacaacataaaatgttgacttgaaacattgcgtatgcatatttgccatgtagacagtgagatatggaggtaaactgctttcctagttttgttttgtttttttttttttttgttcaaaaggaattcactctccccttgtccactgttataaaatagcaaatggtgattagcatctgtgctgtaaccagagacactgctgttcccagctggaatctgtaggttctttgcctgctagagattgtgacaagaagccagttaacatggagaggtgtacatgtcagtcttccccagaaaaggacatgaaacagtaggaccatccttccaacccatgacctacatctagaggcattctttttttctttttttttttttaaaccggaacagaaatatcatctaattctttctttacagagaagtggtataaggaagtacattctggccaggcacgatggctcatgctgtaatcccagcactttgggaggccgaggtgggtgcatcacctgaggtcaggagtttgagaccagcctggccaacatggtgaaacccctcgctactaaaaatacaaaaattagccgggcgtggtggcacacacctgtggtcccagctactcgggaggctgaagcaggagaatcgcttgaacccgggagacggaggttgcagtaagccgagttcactccattgtactctagcctgggtgacagagcgagattcgtctcaaaaaaaaaaaaagaaaagaaaagaaaaaggaagtatattctaagcccttgaattgatcttggctttcttcattatttttacaagtaaaaataaaaactttgatatttctgatgttctgggatattataggaatgataccacttgaattcagctttctaagaagtctggtatttcaatagtcttaatatgagtaagaaaattatgatcttggtactggatctaaggcagaggtatcgaagctgttttaatgttgcttgagataggacagaacttcagagtaaaataaatgtgtatagacaatctgttcaatctgttcaaattaagttgttgagctgtatatttgaatcttaagactactaattttgttgtatctgtcttttcccaaatatatgtgtacttcttttaataagccaaaacctatgcaacttttactaattcttccctaactacttcttttggaaaatgattaaatcttatgtctcacgttttgacatatctattgcatttaaaagataaggttgatcatgctgcttctcaaactgagatatccattcgagttatccaaggcccttggaaaacaatcgttgttgagtctgtatggggggcctgagtcccaggtggtgttgactctgctggtccatgatcctattttgagtagtagactctagtagcgtctcctgccttccatatggtgcagatttgcagcattgagacaggaagtaagaaactgaaaaggaaaaccattcttacctttggtgttattgttcttggtatattacagataccaacaagtatgaggcaatcctgagacatctacctactgagcttttctttccttaaattcacacctcaagaccaaggaaaccgaaaaactcttacagtctccctacatgtgttcacttgtgcccctatttcctgtcattaacatggtagtgtagccaactcctgctagcctgtaaaagctaattattacagtatagaggaattttgtaagccatagccattagtagcttgaaataccaatggtgggagtatttataccatggcagttggcatacactgtaactcaagagtgttctatttgtttgtttttctagacagtgccagtttcccagcatactcctgtctctcattcagtaagaaaaagcacttccccttattttccaatacaggacatgatatcccgagttttgagcttcttgttaatagcctgttgcacgctaaccacgcagctcagtgaagagcaagtttattcccataacaaacaggaaacaaaggttgaggaaaaaccacagtggtacccttttgtgagtgttccctaacaccgtcacgggagtcctgattagtctaaatactttacaagtaaatctccttcaggtggcattttataaacaatctttcatcatggagagatgagaattgggtcaggtataattagaatgacagatgtattggctagcctgagagaattaacgcaattcagtaaaaaggctagccaactgcggatatcttctagttacttccgtgacaaattagcaccatcctcttgtactgaagcagtgctttcattagcatgcacagctgtttgcatcatctttgtttgtatttcaatccatatttggagcttaagtgagatttgtcataagacttcagttcaagcttgcttgcctaattttacatgcttctatttagtaaaatatgattactaggtcataaatatttgataatttattgccttattagagtaattttctaaacatgttttttgacgactgcttgccactacgtacaagcacttgaaaaatgttcttttctattaaaagtacatggttccagaattgggaaaatcacgttcttaaaaaataaccagttttctattgtgttggcttttaaaattttttcatcagtagaatcaaatgcaaatattgtctgcttatttttcaacagaatacaagtttgattttaataacttaggctcatgaaatgtcaccacgtagtaatacttagaattacagcaataacttaggctaaaaaaataaagttgttatgaactacattgagctcagacagatatatgtattatgtaaacatttatataaaatgtatataaattgtatattgtattatataattatatattgtaatatatagtatataatatataatttataaatataatacataaattatatttataaattataaagtttttatataatatattataatctaatatattataattatatttataaattataacgtttatttgaaatattgaagttttgtatacttagtggattttaatatttatgtcgttttcattttattccactgttacattaaggaagtaacttattacaaaaataaattatatttgtcttacatttgccctttttactctacttaaaattggagaaaaagagttcaagatagggaatttctgtcagaaaggagaaatagttgtattatgtgaagtttaagtagatattcttgtagagtatggagaaaataatgctataaaatgttgccttttaaaaaaaagttcagaaaatatagttcctagctctctctaaatgactagtttgattgtgactgctttcccaaaatttgtaaatttaaaatttatacatcacatggaatatagttttatttcacatacattccagtaggctgagaatacttgaaattcaatgattaaaaatgaaataataataaccagctttgctttattctaaaaccagctttattctttatttaccactttatttacagcgaattatttgctaatctgttaactttgcttcataagaaggcattataattatcgtacatttgaaagtggagattttctccccattctggttgccagtttcacaactgtgttcattctaaatttattaaaatatgtaaaatcagctttctaaccttggttgtccacaaagaatttcactccaatttgaaatatctattcagaactaattttttgtggttgagcattattttttgaacaatgaattgcataatcattttgtataatccagggagctctggcttagattctgtattattttgtgttatactgatttttagaaaatggaatgtagcgttgacacgagcacaaatctcagcaagggcctaccttacaaagataaaatgcgtggagttttattagaagcacatgattttgctttgtgtttcgtatacaccagcatttcagtgtagtaaatggcattttgtcttgaagagtgagcagagttgttacaaaagaaggcataatgcttccttgccagcagaattcagataagtgaatatcagaaaagctatttgtgatcttgaaagtgtaagaaattcaacatcaataaaggattgtggttccttagatagccatgtaagtctttgcctatgtttctaacatttctctttaggaaatattcttgcttttatttttctgaacaaattttctccattattatctctgatatttactttgaacagaaaggtggattggaaatcaaaaaataagtttgatttcaaaaatgatttcaaaatgttagttttctcagtattttacattttgagaagagaacaaagaaggcagatgaagagttttttgttttttcttaaatttgttttcttttcaactttatttttaattgacataataattacatatagtatacattttgaagatacggttttaattttcacaggaatcttatttgggtttagttatataaggtctaattttgcatcctctacatttagtggctgatttataaatttccactgagtgataatagtaattaatgtgaaacaggttttttgctgatgtttttagaagtttcagtagattaggaaggaagaaattatgctattgagaaaaatagaaaatgtaaacataagcatttgaactctctcttgagatatttttatcttccatgaaactagatgcggcttattgaagatgtgtttcaggtctcagtgctctaaaactcttctacttggtgagcatcttgattggttagatctcttactaatatcccattgctagagagggatgtaaaggaaattttctcaaactgagatttccaaatcttccaatctctgagtcaagtaaagagacaaggttagaactcttaggcaaactgaaaaatcaatattcctatattatcattatttttttctttttttgacaccaagtctcactctgtcgcccaggctggagtgcagtggcactattttggctcactgcaatgtacgcttcccaggttcaagtgattccagtgcttcggcctcgcgagtaggtgagattatatgtgcacgccaccatgcccagctaatttttgtatttttagtagagacagggtttcgccatgttgactacgttggtcttgaactcctgacctcaggtgatctgcccacctcggcctcccaaagtgctgggattacaggcttgagccaccatgcctggcttcctatattcatttttttatgtgggctttttaaaatcttttcaatagcaaagacttgacaccaacccaaatgtccatcaatgatagactggattaagaaaatgtggcacatatacaccatgaaatactatgcagccataaaaaaggatgagttcacgtcctttgtagggacatggatgaagctggaaaccatcattctcagcagactatcacaaggacagaaaaccaaactctgcatgttctcactcataggtggaaattgaacaatgagaacacttggacacagggcggggaacatcacacaccagggcctgttgggggggtggggggttgggggagggaaagcatcaggagaaatacctaatgtaaatgacgagtttatgggtgcagcaaacaacatggcacatgtatacctatgtaacaaacctgcacgttgtgcacatgtaccctagaacttaaagtataataaaaaagaaaaaaaattaaaaatcttttctttgagacaattgtagatttacatgcagttgaaagaattaatagaggccgggcgcggtgcctcacgcctgtaatcccagcactttgggaggccaaggcaggcggatcatgaggtcaggagatcgagaccatcctggctaacacagagaaaccccgtgtctactaaaaaatcgaaaaaaattagccggtgtgtggcgggtgcttgtaatcccagctactcaggaggctgaggcaggagaatggcgtgaacctgggaggcggagcttggcgaagcctgcagtgagtggagatagtgccactgcattccagcctgggcaacagagcgagactctgtctcaaaaaaaaaaaaaaaaaaaaaaaaagaattaatacaaagagaccctgcatagtcttcactcagtacagtatcacaactattaaattgacattaatcccttaacactgctttaacccaagtctatgctgctgcttctccgtgttcacttctgagaggcactggccatttcttgtgtgcttattcatactttgtgtaaaagcattagcatcatacatcgctggtgctgaccctaccctcagtcccagcttctcccagagtaggctaagattctcttttctactacatggaaaattgttctggaataataaagggttagcaaaaaagtcagagaaaacaaacagttgcattccctttccctgtagtagagtaggaatataattatgagtgatagaggatacgttccattcctttcccagtcctctccgaagtcagcttcactgctgtaggaagttgctgttctcattatttccctgagggaaagtgttgggaagtgagagttgaggtgatggggaatcagggttgctgacaattgggggaattataacgagaagctctttttcaccaggagaggggttgcatgttaagagaaggcctatctgctcatcctccatgtcagcagatgagaaccagttggacaaggtagctgtctcttagagattgagaagtaacaaaagcacactgtcagtcctgttcttccagcctcacgtacatcttctccatacattatgtatttgacattaaattaacatacactgttacacccattcctgaccgcattatctcaggtagccttttgtatttgagtattgtgggatctgttgctattgcccatgatgcccacttggactccaccaaggcagtgaaactcttgggggccgttcaaagtcaagagtgccaactgcccctaacaggattgggagaaccaaccaacactccccgaatagggactaactcactcttttcttggcctttatgaaaggaaggagttaaggctcttacagctggagactccagcaagagttgtaggctcaacgtgtagcttatactatttacttaattaacatgtaaatggattttgagttctgaatgcttgttctagttgattagggctcatttagcctggcttctacgaattagctataacaaatggtttcatagctgttatagaatgaggcagaagaaaataaaatgaatgtagcattatgtttaattagtggtataggaaaatgttaatataatgccatttagattctggactggggagattgtgcctttatcataagtaagaaattgttgctaggtttcacataagggcacatagttatcatgaatcatctccttcgatcatcattcttttatcccattacttgacttgcacccatccaaaattctaccacttttatttaatatatagactcataaagacaaggtttgtgcatctgcagagctgtgatgttcactgcgaggcccgtggcacacatctataagaagacacatatttggtactctaagatgatacttttttttaatgccaaaatgtgagggtcagcataaattgccaaggcatggtaaattttgttgccaatgctcccgtgactatggggtgaagggattctgtgcctcccttggtagcaatgaccacggtgcttgcaatcccagtgccaattcccggcacagtgcaggctctggaggcactgctgccttgcagtcttattggaattaacactgcctgagtaagagattaataatgggtattgttgtgtcttagaaacgttaaagagcatgtgacatgaatatgtacacattggtgaaggagatacagagaaggaaagcaaagtgaagctgtagatgtttgttacaactgaaggtaagctctgggagcagagaccactgctggctatagttgatgggatccacaatgtcaatacaaatggggactaactattgttttacttccctatacacgttgctctttcagtagatgcaataaagtactggtaaaaccagaggtggctaccatcacgatgatgtcaacaggagggacagtcagcactaagcccagaaggtgtcaaacactccgcaggagaaatgcgccatgcaacggacatgaagatgatctgacactcttcacgtggttttcagatggaaacgtggctacgaaagcatcaacctcattatcatccatcattaaggccatctcactcagtactgctgctttcaaagtccacgctcccaaagcaaattggatttctgtacacaatactcttacaggatgaaacccaaccaacttgttgacgtaagtatcccatctacttcgcaattttatttatcttccaaaattaaaggactggcaccctgatttattaaaagtgaattgggtctagggaccatatcccctctgagttactgacagagcagcttctggcctgtgaagctcaaagccatgcctagatgtgatggatccttgtctttgattggctaattagaatcaatctgttgaaggaccagtggcagtggctcacgcctgtaatcccagcacttagagaggctgaggcaggtgtatcacttgaggccaggagttcaagaccagcctggcctacctggtgaaaccccatctctactaaaaataccaaaaaattagccaggcgtgctggtacaagggtaatcccagctacttgggaggctgaggcgcaagaatcacttgaactcaggaggtagaggttgcagtgagccaagattgtgccactgggcggcagtgcaagaccctgtctcataaaaagaaaaaaagaatctgttgaatattcctaacttggaagtaatgggtgatgcgtggctttcatcttttagaaaggtgttttttcctctgtcagtaaaactaagaagacatctgtgtgtgctaaggcgtcagtctagcaagggcagggcacaaacccagagagagaattgggctgttgtttcacttccaataaaaatgggatatacatgggaggtagagttataattctactcaggattgactttatacatgcaattggatgggtcactgattgactttgaggcaatcagggatgagtgaaactgatcttggggagggtggcaagacatgttgacaggtaagatgtgttttaatgtataacagtgcgtggtgtgtattaatcagttggagttgattgactgcgttttattgtttggaacattcctgcccaagggtcaggtaaatatacaaaatatacaaataatacagatttttaatacataaatatcaattaagtagcataattaaataatacattgttatagttgtacttaatgtgtatgtaaatatatacaaataatacagatttttaatatataaatatcaattaaatagcagaattaataatacgttgttatagatgtacttcatgcatatgtaattaaattattaatgtataatatataaatacatattttaatatacaaataaaatggtcttaaatcagagttaatttaagaccatttatattagtacatatcttaatatacaaatgaatggtcttaagttaatgtcattgagtataagtcacatttacagatatgacatgtgtttccagataaagtcaatggacagacagcttccaacactggaaaacattcaaaatatatgcaattaattttatatttgagttaaggcaatcatttattaaggaaagcaatcagatgtttgtgagggcttaaactttcgcttcataaccaaagcagtttccttacatgaaagttgacttcttaaaaagagaagtttattttttataatggagaattgttgtgatgtgcagataccttccgtcatttcatactcatctaaaagcagccaaatgatcttttcacctttggccggaatccttttattgctaccgagtcctgcactcattaaaccagatgacagtgcatgctctgagaggtgtaaatctctagtcctggtggccagttaaattcctcagtaaatgtttggtagatgctgcctaataaaccagtccaggttgccactgggaggattaaaagaagtaaacgtgtatacatgaacagagagacagtgccttttcatgctaaatgtggttccccacatctcctctgattagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccagtaagtggacccttcttcgagcctggccacctttcgtctctctcgccactgactctgctttttgtaacagattgattttcctggttcttgggaatgggcctgttgctaccactaaccacatttctgtccacttctctaattgctcagagtctccgcagtatgttcaatcatgagcacacctctccgtctttccctgataaagcatggccatggatgtgttctcttcctagctgtagcacatatgtcttgcaatccagagggacttttgagtgcttctcttttaaacaaagctggagtggctgttttgtcttctgcagccagccgtttctgcaaatgcatacttatgtgtttgtccgtgtacatatgtgttcatgtttatgcatgtgcactacctgtgcagatactgtctaccactggaagcctggctgatgcagcttgagttgcattgataaggtgtatggctgtgatgaatacctttaagttggttcataacatgtcttttattgtgctgatgagggaatgtgattgaattgagctcatgcatctcaaatgccggagggtagaagtgcccgtcttgccccctccgagctcagcacacagacatttgccaggtcaaacttctgcttcttctcttgaaagtagaagaaaacttttgacttaacgtgagaaactttcaatgacataaggctcgaggaacataattttattttttttgtttttttaaagacagggtctcattctgtctcacaggctggagtgcaatggcgtgatcttggctcactgcaacctccgcctcccgggttcaagtgattctcctgcctcagcctccccagcagctaggatcacaggcacatgccactgcgcccggctaattttttgtatttttggtagagacaaggcttcaccatgttgaccaggctggtctcgaactcctgacctcaagtgatccacctgccttggccatccaaagtgctgggattacaggcgtgagccactgcaccccgccagaacataattttcaaagtctttctcttgaacattaagcttttcataattccgggggataaaaatatgaagtcatgatgacttaagtgcatgatgaaattttccccaaagaggtaattctcaggaggtccagtaccagatgtgagacttccatgtcgttaacagacttccaagtgaaattcccaattgtgcttatttatttatttatttatttatttgttgttgttgttcatgagtaggaagtatgaactactcaagaagtaattattcagctcagcttgataactaaaaatgaaactcaataactgtgtattacttttttgagagactcctgcctaattctccgctgtgttgcaagggtggcagccacatttcctgcctgagattcctagggattatataaattgttttgcagcaagatcttaggattaagcaaaacaacagaagggcctgcaccattaatacccccactgtaaaggagcccaggatctaagaggaatgtaatggaaaagctcctgttggtctcctgccatcgccagtgaatgagatgactgcttcagtcccatgtgtgaacaggtgtaggaactgataacctcaagggctttttttttttttttttctggctctgattggatgattgcagcttctggctcaaaggactcccttcttcagtttcaaacaaagcagtcaattaggtcaggtattgcgaacacaatggagaattctgttgcctgcagcctttggaacaaaggccttttgttacagtgattctcactggtttagccggtgggagaggtttcctggcagatttgcaacttttttctccctttccctgggtggattcattttctgaaatatcatgtatagtttttggtaataagagatttatttggttttaattattagcagtgatgaatttgcttcaagagattaaaattctctccacctcaccccagtactgccatcccttcacctaacactctctccctttgatcagtttgggctgggagtgaccagtgggcacctgtccaggtgtcctgggtggcacacagtttgctgagggttttgcaaaaggtcgatgctcccaacagagatgtattagatgaggctagctatgcctgattttagaggggaaaggtgacagaataatgtatgaagaaggcaaaggctgaagatcagttagatgggtggacaagaataagtagagagtataagcctcagcaaacagccagagccgagagccacatgctgtcctatgaatgagtgaaataaatggagtttttgtgaaaaaatgcatcgaagggaattggggatatttggcacaaaaggagcaagaaatcctcttctgttaagaaacctgttgttactcggatatactatcagagacaaaatatccagcattctcaaatgttaacttcttacgaaaatagatcttatgtttatatgttcattttggttttgttggagggaccaaacctaagtgagtgattttgtttgttaggttgtttttttgtcagtggactcgtgcatttcagccatcattcccatgtttctctttttgtttttagttatgttctcttattttttccatagtgtcccaaagtttactcaagactacccaggaacctcttgcccgagatcctgttaaacgtacgttgtcattcacctgagggaagggaagaggggaggaggatgctgcttggttcacataactccagcatcatcaccttctttgcatggttttgtgtttcttgaacacctgtcttagtaaaatgtttcttcccattaccttgcttgtaattacatctgattttgccagacagcttgagatgttgggctaagaacatcattgactaagtttcttctatttctgaccaatttcctttttatttagtctggttttattgaatattatatggacaacatcattgtattgtatttgccattactattttatttcctaaaagctatcagtgtaactgagagcaggcttagcctctcactgcttttgcagaactgaagaacaagggctaggtgcagtggaaggaaagtgactttacttagcaaagctagcaatggggaaatggtccaggctcctgcctcaaagcaaccatctcaaattttggattaaaaaacaaaggcttaaaaaggggagcttggaatgcagggcatgaaggaggggtgaggaggtgctgctatacaggacttgttccaaagacttgagttattatccagttcggtaagtgggctggcgcatcccgcacaatcgggttgtaaattaactgcagccttgaggtgatctcctgatgagggagaattctgaaggtgcctaagtcagtcagtggaacttctaagcaagcattaataattttaataataattataagcgtaattagataatggaagcgctgtgcagggagtgcctggtgggaagaaagagagcaaaggttaccatttcattactaaaactggaaggaaaagaaaggaagaaagatctttaaaatagagtactcggttacatcaagatgccatgatttaacaagagactataatacataagtaacttgtttcctcagaaaaagtacttaatattcatggtattgtagtacatggactaattcgtacacgcagatttcaatttatgtgtgttataagacccggtttcaactttagacatgaagggtcacttttagacattaggaacccctctttctcctctcccagaaggcataatggtaggttagaggtgctcaccttttgactaggaagtagagaaagagcctcctataaagaaatgcattgtccagccactgcaggccttacttacagtgtcttatgttttgtttttatttcagttgtaatatcagacgagtttagttttaaaatgtggttttagtactcatatttgaatttggattccatccagaaatagatttatccagtgttaggttagggatgatatatgccatttatgcttatgattgctggaagaagaggcacaatttcagttgtaacttagatattttataattagcatttgtgtacattatcctgaaaaaaaaaaaccctcatctcaaaactgatgaagccagttatcttttttaaagatgataaattatagatgaaggattaggtattttaaaaaagactgcatcctaaactataaagttttttaatggcctccataaaatattcagaataattcacattatgtataacttttgaaggatgtggtttgtactgctgcaacataaacgtttcttttgctgttgtgaaaaaagcatttttctctaaaaacactgtaagtacagcaagtgggttgacagactaggaaaaagctctagctattccactatagtgttgacataggtacgcatgttgagttgcattgtaccgagcattttcacagatcatttaatttttcttcagaacactttgtgggcattttcctcattccttttgtacatacgagaaaaaatgaggcttcaagagcttagtgacttgtcccaagccatcgaacatggcaggaccaggctttgaaacccaaaatgacgttttggccgcactccacaccaaatggctaagcattggttctgacattgttttgccggttagtgaaatcacatttgcgattcagaagcacattttaagaatacagaaaacagtgaaaagaggatgaagaatgttaacattttttcctaaatgccatgaatagagcacgcatcagtaaattaaatgtctttcccattcttttataaaacagtgattatttttctcttgtttcattttagcatttataagaattctatttttccatttttaataactgatggaaacaagcatcattgtctgataaatttattttcatgctgtacacgtaactaccactttcatcatccactgttccaaacagatactgaaagtctcttttgtaattttctccttcccagtaattttctccatctacttgcagtgtatttgggatcctgacacctttccattctaggaggatgaagtgctttgggcagctatattttcttgtctgcctacagagactattcaatcacagcaagtgaagggttttgcagtgctagtacaaacagacaaggaaaaaaacatataatttctagttatttatagcctgtgcagctatgtggtcttatttatagcaaactgcacatttgatttgaaaaagtcatggtcatctggaggtcaaattcagatggcagactcaattcagagaaaaggagctgaactagaaggtaagcaagcctgttagactgggcaacttggacttgactttgctccttcaacaatctagagccagttggatgatatttctgcacaaaggtggttggttttacaggttgctcagtctaagctgcttctagtcaaataacaaatgtgaaaggagatagaaaaagctcttcagttgaactgataaaagattacacttagggagaaaatgtatgatggtttgcattataaaaacaataatttgccataaatcaggcatttctaggtttcaaacttttgtcataaaaaccaattttgagcattgcaattttagggacatattttattgttgttattttaaataaaaatctaaaccacaaatataaggctgagagctttcattttattcgtgaacataggaattcaaatcattaaaaaaaaaccctttctcatttgggataaagaatcttacgagagctgagttaatttctgacattagttttgcacctgcccatttgggtttaggacagtgcaaaaggtttcacatttaatcttcaaaatatagtatttgtagacaataaaattatataaatatttgtggattcatttatattttaaatatgagagtgtgaccattttttctggtgctgtctccatcagactgcatcccaaaaggcaaacagaccaactccttaatggcatttaatctctcaaagagcatcatgccaatttttagtcagcagattgcaccatgtgatctggccaaagtgtgtcccatctcaggctccttcatttgcgctgacatgtggtacaaacaactaaaccaaggtttctcaacctcagcactattaacattttgattcaaataattaatttttaggagtctgtcctaggcatatgggtgtttagcagtacccctgacccctacccactaaatgccattaacacaactccagctgtgataactaaaaatgtctctagacattgctaaatgtgcccagggggtcacattctggttgagaatcctgttctagagtagtagtttccccacatctgactcagagatagaactctcctggtgtaaacacgtgtactttccacaaatttgggggcatgttgaaatgttagaatgtcagcatcatccaattctcgacagatgtttgaaattgaatttgttagactattgtccaagctctcaatatttgcaaggtaaagtggaagttgctgttgctgtcctgactatagtattgaaggtctcgtagttttcctgctctaatgtaagctactgtggcagcagaagagaaaccagcaaatcccttagtttgaagtcattggttcacctatgcaccacccctttctcctctctgtttcatcttagtttcctagaatcccaggatatgctggaggacaaccatctgtagagatgtcctatagtcttgctacacaggttatttgtactttaggattatgtttgatggccttatagtttgtgcagaggtgtaggcctgaccccatgcaggattgagggagggaaaaagattgatttctaggcacatcagaatggtccagatgacatgaaacagactggtacacttacagagaatatgaaaagaattggaacttaacaagtcaggccccaagttccatccccaggttccaagtttgttgccgcagaagctcataattttcaaatcgtagaaaactcacaccacgcagcctttcaatggaatatgccaccttaaccccagggtcgttgtaaagacaggagccataagacagaagtctgaatgcctaggccatttaatctttggccaaatttgaactattgttcttaatcacactattcttgttcttttcactgtgcagtagcaaatgttagttcccattagcacattctgcaataccattggaactaaaactgccaaattagattaggcaacctgggattacactttgctccccaaccaacctagggagggagaacaattttaaagcattaaaagatgtgatggtgaattaaactacctgtcacgtcagtgccagtatattctatcagattaacaagtgtgaaaagctaaatctttggtatctggaaatgcttagataggaagaatggctttttcttcaaagccataataattagagatgaccctaaaattgaaaggaactggattgcttagcaactcagcattttttaaaaagaagggccatctactttgaatacaggttaaatatctcttctctaaaatgggaccagaagtgcttcagattttggatttcggaatattgatgtattcatgatgaaataacatgaaattcatttatgtttcatgtacaccttatacaaaagtctgaagataattttatacaatttttttttttttttgagatggagtctcgctctgttgcccaggctggagtgcagtggcgtgatctcggctcactgcaacctctgcctcctgggttcaagagatccccctgtctcagcctcccaagtagctggaatgaatgacaggcgcctgccaccacacacagctaatttttgtgttttttagtagagatagggtttcaccatgttggccaggctggtcttgaactcctgacctgaagtgatccaccagcttcggcctcccgaagtacttcgattacacgtgtgagccaccacgcttggcctatacagtatttttgataattttgttcatgaaacaaagtttctgtacgttgcactgtgagagaacaaaggtgttgctatcccagccaccatgatgtcatgtcagtgctcaaaaattatcagattttggagcatttcagattctcagattagagatgttctacctgtggtaaaagaatgttcattatgtctctgctctgttgtttagctatttgccaaaagagggtaagtggatcgtttaataaagtggtcagcaaatatttttcatacaaggccagattatagatattttaggctttgtagatcatgcagtttgtcataactacttaactatgcagtggtagcatgaaagcaacaatagacaataagtaaacaaatagacaaggctgtgttccgataatactacttttataaaagtagccagcagctgggtgcagtggctcacgcctgtaatcccagcactttgggaggccgaggcgggcagatcacctgaggtcaggaattcgagaccagcctggccaacatggcgaaaccccatctctgctaaaaacacaaaaactagctgggcgtggtgatgggcgcctgtaatcccacctactcaggaggctgaggcaggagaatcacttgaacccgggaggcagaggttgcagtgagctgagatcacaccatcgcactccagcctgggggacaagagcgagacttcatctcaagggggaaaaaaaaggtagccagcaagctgatccttggtttaatacagcaggtttttttatttttatttttattttttttccaatagctttggggatacaagtggttttagttacggggatgaagtgtatagtggtgatgtctgagagtttagtgtccccatttcactgagtagtgtacattgtacccaatacgtagttttttatccctctcctccttcccactcttcctcattctgagtctccaatgtccattatgccactctatgcctttgcataatcatagcttagctcccaatttataagggaatacatactgtatttccattcctgattacttcacttagaataatggcctccacctccatccaagttgctgcaaaagacttttattttgtggtttttctggcctactagtattccgtggtatatatacaccacattttctttatccctcattggttgatgggcacttaggttggttccgtatctttgcagttgtgaactgtgcagcagttatttttgaccccaggatgtgcgaggccaggtattttgagagacaccagcaaaggaatctgagtactggctatcaatacctgataattttattaatgagttgagacccagatatgccgtagaggtaaataaccatataaaggaaatatagaagtgtaggagaagattgctctggaaggctggggtaaaatgaaatcagctttatccttaagacctccatagaggttaactgtaccatctccttttactgctacagtttatatgaaactggacaatattgaagattttgacttttcgaactcatctattgagtgttgagcagctatgacaggttatttctttatgtgcctccattaacgaagtcaagaatagcttctgacaaattgacaaaaaacaataacctaaggttaacccattctggacgccagttattgctattgcttcacatatattttttagattcaaacttgaggttgcttttaagttttagtgtgatgtgctgaatagagaatagatgttaataaaaaaataatgccagcattcgttccttcacattcagttcatatatttgaaaaaattcccatgtcagtatgtgtccatggacataaaaaagaaatgtagcttgactagagtaaacacatcatagattatatttttattaccttatgtccatgtgatgcattgatagtgttctccaccaactatgattgcactgactataaaattgtaatacaagggcatattagggggagaatgcctttgttttttcttttgttgttattttgtttttaagagagtctggtattacactggaggatcacaaactgtattttcttgttataaatggctcctctatcttggacttaatggttaggataaatatttgaatgtagaatgcgttaggagttttaactatttttgaaattaggaaaatggagagacactttttttttttttagagacactttttttttaagttataataagcatggcactcggaaagctctgccatgtttcaagattaaagtttcacatgaacgctaacaagtttatatttcactcatatataaatgatcctccttgtctcctttcctaaattatagccatctcaaatgacaacattgctgggtcggtatcaaatagcattttcaatgataaggcaatgatttatataggtcttaatttgttttaatcttctgttaccaaggctgtagagataaattgcttttctgctgatgaaaggagactaacccaattttcttgttagaatctaatattaatatatcgactgaatgccattcataagccttggtttagggaaacattcagccttctggcctgttggagatggccacggtcattgctgtttgaaggtgggtcatttcttcttttgtgtcctgagtccattgtgactgtaaaattatgggtcaccccagagcctgaggaaacaaatgcatatcaaaatgataggggcaatctttcacagtgcctttaattttgaccccacattcttatatgaatgtgaagtaccacattagtatgaatatgaaatggagtgctccgcaatgattacaaaatcagaactaaaatgagggaaatcagtgcatgtacagttcaacttaatggattatcctctaaggagtcttcagacaggctaggagagtgacgtctgcctcatcctgaagatattagcaggttttcccctgttttaaagtaacttcccttcaaatgctaacagttttctcagaggaaacacaggtatggaaaatgtttcgttggtgtcttggccccagtgatggaggagcattttgtgataggaacgttgggtgcagcatcgccatttatgaataaactgaaagctaacctgtgttacttcaccccagaaaacagagctctggcaggtattgagaatagatcacagtgtgaagtggcagtattgtgacaagcatgcgtgtatcagtattaaaattgaaatgagccctcacgcacatgtgaaagcagtttctcccgttttcatattcagttccctgaggtaatacagcattttggtgtgagagaaagaagggaatctgacccttctcgtgtgggaagggggctgagggcaacaacctcctgtgacagccaccctggtccaagccaccttcatctttgtctcctttttttttttttttttttttgagacagagtttcgctgttatcacccaggctggggtgcaatggcacaatcttggctcaccacaacttccgcctcccgggttcaagcaattctcctgcctcagcctcccgagtagctgggattacaggcgcctgccaccacgcccagctaattttagtatttttagtagagacagagtttctccatgttggtcaggctggtctcaaactcctgacctcaggtgatctgcccgcctcagactcccaaagtgctgggattacaggcgtgagccactgcacccagcctgtcttttcctcttaaaagatcttccttctacttttgtcccatagcagccagagtgatccttcaacaaaacgccccatcacatatactccccctcaaacagcccacgctggtccctcagaatccttactgtggctttaaggctgtacatgatgtcccccatttcttccctgcctctcccactacttcctctcttgcttctttagctctggccatgcgggtctcgtggaatttgccagccagcttcaactcttagggcttccgtgctagttttgtcatctgcctgccatgtccttccagcagccagctgggaagatctgaatgtcacctcctcacttaagactctgcctggtcgctcacttactgcggtctacctttcccctctcccctcagctctcccgatccttctgaactctgctctgtttttctttttcctctttttctccataatacaaatcacatattaacaatatgacttactggcttttaaaaaattcttgtggtaattgtttctttccctagaatataattccaccaggatcagggccttcatgtttttctcattggtttctcccatgtgcctcacatataataagggctgcaatgttggtgggctggaggaataaaagaatgaacaggcgcactaaaggcaggatagtttgtccatgtcagagctgctgtctcagctgctttgatacctctgacttcccagggtggcaaagaataaggatgtggcttatgtagaaggcgttagtcatccaaaatgccactgtatatttggaagcaaatattcaccttgaagcagtgatgtactaggaattagaactgcttttctgttacattttttcatttgttatgagtgtttagatacacatgatcactattaaaaggaagggaggtaatagcctatatatcctaccatgcccctcaaggctctgttaggagactaaaatacaaaggtcatttaaaaagttaaaagcttatgcatgtgatgttggtattgctgctaatgactaggcatctagaggtcaaaacctagagctaaggatattgaaccctgtgttttgtctcgttttaagtctaggtttttgtggaggggggaacatacctagccagcttgcttgcagaaggcatgagtgagcaggctgaaggagggacccaaggccagaacgtcctccatattctagctccatgggctctttcacttgatccctgctttatgacccaacttctgttgaaggatttgccagatagtgtttggggcaggaacagctgtttcatagaaaacaagccaacggacatcataacaaagcatatggttgttttgccaagttgtgctgctcattaacaaaacaaaacaacaaaaaccctttacagtgccccagcatgtggatggattggccctttactactctaaaaattagctttacagcctttttatggcttacccaatcttaacagactttatttgtgtgtgtttagggatgcaaatgggtatgttaaatgatagtgttttgcctctacgcaataaaatagggtaattttttcttcccatgtattaaacgagaacacagaacatgcctagcatggtgggctctgatgaaaagaggctgttatcatttggccaacatggaaatcctagcctttatttatttatttatttgagacggagtgccaacatggaaatcctagcctttatttatttgtttgtttgtttgtttgagacggagtttcgctcttgtagcccagactggggtgcactggcatgatctcggctcaccgcaacctccgcctcccaggttcaagcgattctcctgcctcagcctcccaagtagctgggattacaggcatgcgccaccacaccctgctaatttttttattttattttattttagtagagacggggtttctccatgttgatcaggctggtctcaaacttccgtccacctcggcctcccaaagtgctgggattacaggtgtgagccaccccatccggccgaaatcctagcctttatcagaggttccgtggaatctcagaggtctgtgagcaggataaactgctttatggtagtttaaaatgcaaaaccagaaataaaccctcctaaagccagtttgtttccactttctaagtggttacagtgacctgtgttttaagtaccttaaatatatcagtgacctgctgatatacagcttcctgtttcctctgtgtcctgtgacatatcctgacattccttgagccccactcccttcccaaaaggaagtaccttgatgggtgaggacatagggcacacgtgtctctggccttctgtggacataatcacaaaatggtagtcagtcctatgaatttaatctctttaggatataaggatattcacgaaatagaagttgagctctctggacatactccaccttaaaattgctctctccttccgggatcctcaccagctgcagagcagtagtaatgaactattaaattcatttaacaatatcagcatatgctatccttctctgcttgactagacagtaatctggcttgctggttggtatgaatataggataatttcactcacactaattgagatggggagtttgtatgaatggctgaaaaatttgagttaaagataaaaagagacacagcttcctcaactatgggaaataactgggactgttaacaaagatttacttgaagagaaattgtattgctcagggttctccagagaaacaggaccaataggatatatatgtataggaagagattgattctgcagaattgactcacacaacaattatggaggctaagtcccacaatctgttgtctgcaagttggagacccaggagagctggtggtatgatttagtccaaatctaaaggcctgagaaccagggaagacaatggtgtaaatttcagtccagggagaagagaagaccaatatcctgactcaggcagccaggaaataaaaagggtgaactgctccatcctctgcccttttgttttcagaccctcagcagatcgggtgattcctgcccatgttgaggagggtgatttactttactgagtgcaccaattccgatgctaatctcatccagaagcaccctcacaaagacactcagaaacaatgtttaatctgggcaccttgcggcccaatcaagttggcacagaaaattaattaccacagaaatatttctggattcaatggattaagttggtaatatagtattcatattcatttccacgtgcctaaaaagaaggtttttatcctttttaatatcctcagtcctattaaacatacctcacattcatgttccatggttattctcttattatgttgctaagtgcatttctacttaggccaatctgattatagtgattcagattatagtgtttatcttctttcctttatacagtagacagtgttcgcaaaccataggagctgaaaaaatttccttcttatatagtaagttttatgattccagttttccaaaggggtgcttatgttatggttataacagttacagccagatgactatcttcatcagcaggtataaccccaaatatttatacattttcatttgtttcaaacataaaatatggtttgcctaaacatgtcattctgccagattggactatgcaaaagaatgttactgttttattttctgcttttactttaacttgttctcatttgagctctaccagttaagatgagaagatgactaaagctagggaagcacattttaaatgctaaataccatgttcatttcaagttgggaacttgaaatgcaagtatttttaacttaatcattaagttaaagtcagtaagaacgtggtatttagcatttattcattttaacttaatgattaagttaaaaatacttgcatattggtttgcttgaagctatggagaaaaacatttaccttttttccaaaaaggtcttaatattcaaaattattgtttcaatcttacaaattaacaatttacttatttttgatactttcggccttttttatgtgggctacacctaacattttttgaaaaatacatactgcttttcctgtaggttgcactttgtgatcctgtgtgtaattcattttcagtggttctattttatttattttttgttagtttgtattttcttttgtttctttttctcaatttttaaaattttaaaacttgtccttttcttttttttctttattattgcactcttctaccaaaacattttcagtggctttgaataaaagtatcagaactttcccgtggttagcattagctctgagatttgaacaggatgtattaagcagaggaggagggaaggccactaacatgtatgagctccactgtgtgtcaccctctctgccggatgacttacatgtggtatggtatctcattttcccagctctcctatcatgtcctgcggcatgttatcaccacttgataaaaaaattgaaacatggagtgcttaagtttcctgccccaggtcacagctgatctgaaaaagaaatgggattcaaatccaaatgtgcttaattgcaaatccccacatgactctttccttccttccttccttcccccgttgctgccaatgtaagaaggaacaccactccctcatttgctacagagaagacaggggcagctgtgtaaaggcaccaggaatatgccctgcctccttccttccacttgaaagcaacatctggatagacactcaactgcttttattttttgaaaaatgattattaatcaggattgaagtggagggaaaaaatcaaaacgaatgtttctttttaaaatgaaagatactgtttaattatttaacagccttccggttttagttaatatctttgaagactttggattaagattccagacattttcttgaaggatgtagaaaacgtatttaacttcaagtttagtttcaaaatgacttagctatcaattcttctcattgaagtcctctttgagatattatatcccaaatgtaatacacaggtaataattcaataggaatacttggaacattggtgatatttgaataaccttttgaatgaaacaattgatttgatctcaaaagatagtgaaaacgtctcattttgttttttatgttaaatatgcttcctcttaagtcaaaattcttttttctttttgcttttaagctcataaatactctgaattctcactaatcttttggaaaattgcttgtataggtattataattcacttggctcatgagttacataatatagcagtatatgttgcaattcaaatattgcttagcagtattagttgaattcaaaatagaaatcactttctttttgacaactagcataatgaattcattgactattgtcaaatttatgaagacagaaaagtccttttgtgattcaaaaatgtgtttattgatgtttatatatcttttgtcgtgtttccatactgtctcatgaaggttgtcttcgtaattcagttatctaaatacatcatacatttaccttttccctggggtgccgttattctacaacaggctaattacagatatctgtggtttctgcaggagtcttagtgtatgatattgatgatatcatcatttactttcaaaattgcaaaatagtaatttaggaaagcatggggatttggaaaaacatgtcttcagcaccaactgtttttgctctttgcatgcttgtttcgtaaagaactctaatgctataattgcaaaatggaccattttaaagatttttccttcattctgtacttgggagtggtgaaagacatccttactgtgctgcacagtgtctcatggtgttctcttaaacagcattaacgtcttgtatgcgctgctttactaaattctctgttctgagaaataactgaaaatacggctttctattaaacgagtggattattctgttgttgttggcttttttttctcaaacctccttctcttctactttatagttcctacaacagcagccagtacccctgatgccgttgacaagtatctcgagacacctggggatgagaatgaacatgcccatttccagaaagccaaagagaggcttgaggccaagcaccgagagagaatgtcccaggtaagtctggctcttccatcattcagccctacgatattgggaaacctgagcttgcctctgcctcagtctccccacaggcctgctggctttatcaagatctttaaagatgtaaagttctaattttaaatgtttactgtgtgggcacagtttgtgggttttttgcatcctccgtgaacatgctgcctaggaaggatccaggtatagttggattttgtaagcacaaattaaatgatgtctgtaacattctctctggcgaagaaaggtacttggcattattattctgtgtatatgtagtacctgtaatcaacatgttgtaaattaaaatccatcaaaatgctctttagtaaagatgaggttttgtattaaatcccagactgttataattgtgaacctacgattgtttacagtctgtaaaatcatagagacttaaaactgagctgaaccatagtgattatttcatctagtctcctaagtgatacatagtggaatagaggttcgagagagtggcttcccattttagcacaaagcaaaatcagtgagccagagacaacatttagaatccaggcctttcttgctcctagtacagtactcctttcattatactttgctgaaaaaaaaaaaaaaaaaaaaaacctgttttggtttggtttgtttttttttagcaggtccttaattaagcaaattaaaaaataacttatgtctaaaacatggctaatccatatatactatcaactacaattgaagctatgtctgctaccaggcactggatgttgtattggagtttgataatatggaggattttagcccttgctcagattcctcattcattcattcattcaatcaacaaatatggacttattattttccagtcacttttctgatttgtagtctacaaacctaggagtgaatgtggggggaaaagaagtaggacataaaagtgaatgaataaagatctcaggttaaagtaagccattcatttttagtgttaatattctgtggcaaatatcagaagataggagaaatttttgtcttagcacagatgcttaatctcttgagagacattaaatgcaatttatgaattagactgctgcgtattttctaagatcacagtcagtctttagtagacaattaatctttcctgtaatttctgatctgggtccctgctgaccccaggaagattcctccctcccagggccaaatgaatggcccctgagcatgtctttcccatgcaaaccagtcaatcaaaagctccttactcccaaccaccttcttatactctgggccactattcacctgctctaatcaccccaggaccaggtaccagaccactagggacaacctcatgccccatcaccattatttgaactaatcagtcctaaacccgcctaccctgcttcgctcattctttccatgaaaaccacaataaaaggctcttgctcatgttttcccctcctgaccaaccctggtgcttcccatatgaccctgcatgtagtggcatgtaccggcttcttgggagctgagtaacaaactgtcttttccatgataatcatctcctgacctcttggcctcacctgaataataagaaaatctacccttgaaaacataaaactaatagtttatctagaaaggtacaacacaggtactgttttttgtttgtttgttttgttttttgtttgtttgttttgccttaagatgaataacaatacttggatctactttggtataataacataaagaggaaaaaagccttataatcacagtacttttggctctggaatataatgtgcagttctagtggctgcccacgatgaaaacctaacagctaattgaactagaaagctagccacagggaattattaagttttcacctgatgccaagaaaatcagatctttccttaggaaagacacaggcactgttcggaaagcattggaggactatgaatcatacttattgccactgaaatgtcctcatttgaatttacatcctatctcccttctttatgaagctttcagaggcttcctgtgccctcacaaatccacttctgggcacatgaagtcgtaaaaaaagaacaatgacaaaaataaacaccgaatgctcagcttgtcattttcagcgcctaccactgtaccctgactctggtcttcctaccacctcttccttctcaactgctacccttgctttctgtacagcgttaagctgctgttctgatcaggccactctgctcatcgtctgttcatctcatcttgggcttccctttgcccttggcattgagttcttctggaaatgccctcccactcttcttcacgctgacacatctcacccattccttacaccccacttcatactcagaatgagacaggcagtcattgctcttacctttcatttaattctaaatatttgctccccggttttgttagtgatttctggacacacctgcattatctttccaagctggatagaaaccttgagacctcaagtcatgaagcctgctacctgcattcatcgtggacccactgtagcattttttttaatgtgtgtttttttaatcctggattttttctcctagtatatcttgttcatttttgaccttattaagaaaacttatttcaaattctctgttagttttagatgtgacaggtcttctttaaaataataatttaacttttagcacatctgtgtaacttgtgacttagttcatgattttgtagattttgttcatcttttagtcatcagatatatctgatataacctaagagatgttgtcccagagcagagaatgttgtctactagattccagtggtcataggaatgtgagacacctgaaatcaatatgtatcttcatagtctgtggtgctgaaatctagggacttttcaactttaaacttgcctgcctcttaaatctctacttagtagtagtcattttctctgcatgaaacagccaagtctttgaagattgataaatccaaatgaaattgatacctttgtgcctgcagtggaaaattgctttataagaatccatagagccactgcaagggccaggtcctgagaattttaaattttaaaaattgtgcggttttttaaattaagttttattgtagtttttgttatatgttttcttacaaatacagaggattttggaattttttcatattttggtttgttgttgccattgtggagtataactctaaacctgtagatttttgttgctaaacctgtagatttttgttgctatatgtcgtgactagcatctagtcaaatagaaatctacagctgaaccatgtgtgagcacttttattacttataaacttactacttttagtatatgcttaaaatgaagtccttcaaattgaaagctgacccaactcataggtttttatttcttttcttttttggagatggagtcttgctctgtcacccagctggagtgcagtggcacaatctagactcactgcaacctccaactccctggttcaagcgattctcctgcctcagcctccccagtaactgggattacaggcacgtgccaccacgccgagctaatttttgtatttttagtagagacagggtttcaccatgttggccaggatggtctcgatctcctgaccttgtgatccacccgcctgggcctcccaaagtgctgggattataggcatgagccactgtgcctggcctaggtttttatttttaagataagcagcaacattttaagagcgcccctttctcctgtcactaaatataaataaacttagctcacctaatgaattttttattttataataaaaaattgggtaccacagggtacaaaaacatgatctttagagccacagagatcttggtttatattcttccctctcccttttttacctgcatagcctcgagctggtaccttaacctggttcgtaaaatgggatggccctggctaatctcacaagctgttgtgaggaatcaattaaattagatagattttgtaaagctcttaatacagggtcagcagtaatgctacttgttatcagtcccacagtgaaattcactgttcacagggagatggtcagcctacatatagtgtgtattcatttgcagtagagtcttagtgggatggtgcaggtgatttgtttatttgtgggggtataggatattgttaaattgttctgaaaatcaaaatgtgagttaatttctatagtaatgcttatttgcaactcattagctaaataaatctctttaattatttcatggattcccccagcttaaagcttaaagtccagtttcttaaagtgtatgaggtaaaatggaaaaaatgtaaatgtaatatgggaaatcagttctcacattgcagtagaacattgaacttctatctcaaactaattttgagattccttgcttgaagaattgttggtagagtaccaccactgtgaacattcccaaagcaggaaattgaaatatttatattgcaaggcttatctcatctataaagcaaagatggtcttccatttcccccttgcccacaggttccctttattaacttggtagaagcaccaaagcagatgggacaatatgtttcttttcttccatgttctattcttgttcattgcagcagggcatttgtcccaattttgctgtgaaccttgagattatttttgatatgcttttcaagtgtaatgaaatatttattccatcttgtttcctccatggttttacaaaaacaacaagaagaagctaattgcctatcatatacaaagaatgaatgccaatggacaataaaatctgtaattaggaacccacatggtgatttgatatagtattgtctcatagaagtcttctatctatagttatttattccaagcctctttttctttcccatcttgaagtatgttagaagagtctattccttaaggctaagtacctacaaaaaacaggctcttataatacagtaatcaagttttctcatgctttgggagtacacagagtatgcaagtacacatctggcaccaaaccaatattttgtttccttgatctttcttcattttacctagttcagagttgcacttcaaacaaattctacttgtcatacacttgaaaaggcagctgtaggtggtaggaagttaatattttctttgaacaacatacagaggtgcagacttttactttttgtatcaggttaatgagtgaacttctctcagggaaatccaggtgaacatcaaagttgagagcaggaagcattgatttcctacaaaacacattcacctgatatcttagtcagtttgtgttgctataatagaataccccagcctggataatctgtaaagaaaaagaagtttaaaattcggctctcagttttgcaggtggggaagtccaagaacatggtgctggcatctgttgaggacttccttgctgtatcatatatggtggaaggaagaagggcaagaggagggcaaaactgagttttataacaacccacttctcacaataacaaacccactccccccataatgatactaatttactcatgaggacagagactgaatcacctcttacaggacttacccctcaacattgttgcactggggattaagtttccaacacatgctttttaggggttacattcaaaccatagcagttggttactaaattagtgctacttgtaaaaaaatacatgtttgctgcattcagaatattacatgttttcttggagtttttggaaggacttagcgtaatccttgctgttcatgacttaggttggcaagctcaaagggccttaattccccatcagttctttaaagggggataggtcttaggatattagacagcagaagtcttctttttcttcccccattatgtactgctttttggcattgtattcatgacacacacacacataaaatgtcatattttctttaaagtcaaaatatacagtttaaaatggtttcagttgctttcataagagagtaaaacttaggtgttcagtttaatattggaagaccttgttcagttaatgtgtgccttccatgaatagttggtatttgttcacatcaaatcaaatgactgtcagttctcggggtaaaaaaagaccaaccttgactcaaaaagctatattcctgcaataaatatgaacatttatgtttaatatactgctgtgattaattatttatatcctagtgggaggtcaaatattcttcagataggaaggggtatgtaataaattttttaaatatctaaaatgacaaaaatagaggaaaaacataatcatccatcctattaagtctgtattcaaaggatgaactgatgattttaaattcaaatgtttccttaatttataggtcatgagagaatgggaagaggcagaacgtcaagcaaagaacttgcctaaagctgataagaaggcagttatccaggtaaaacctgaacccatttcctaccaaacatcacatgccagcagtctttttaatgagtgtctgcaggtttacctttatctgccagcacctcacgtgtgattgttcatagtcccatgaacttcagctgttcttaatcattgtctagtaattgagttgtttaaatcctgccttatatttgctcccaattatttcaagttataattcattgccataaaactcacattgtaacttgcaatctactttttattaataatacatcttttcagtcaccacaatcttctgctgcttctccctccagcaaaaattatgagaatttgaatttttgatggaaaccagtctcaaaattaccttaagtaaaccaacagtttattatggtcaattacttgaggtactgttagtaagagagggatttttttttaatatgtaatataagagtttcaagagtgcatatatttatccaaagttattagtcaaatcagccttcagagagcctatgaaatactgattttcaatgagaaagtaggtttgatgagggttggagagtgcaagaaagtgaagtaagctataaaacgtagaattagtcaatgttggaatgactatgcagtctttaggatactttttagcactagaagaaaatggaataggatgtcttttttagaagacttgaaattgctgcttcatcctacttattcagtccccatggacatatgtgtttatgatggcagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcgggtaggtctcgctgcagccgagttcacacttcaggtcacagcacagacagtaagggtggggcactgggaactggaagccatacaaaaagaatgaggagaaatgccttgagcactgttattcagaggttcaacccctgtccattccatcttgaaggtcaaagggtcacagggcagctacctccacaaggtcatctctacacagcaggtactcacacttccccacagagcagccagacaggactcccagggactcacattgcaagccctgacttgatttaatattcctgaggtggtgacaattgatggcatagttcaagttcgaacacaaaagctggaaggatgtcttccagtcccttcaggctgctgtaacagaataccatagactgggtaccttatcagcaacagaagtttatttctcacagttgcagaggctgagaagtccaagatcaagacatcagcatacttggttgtctggtgaaagtttgcttcctggttcatagaacttaaattttgtttatcttttatttattttatttttgtttttgtttgtattttgctgtatcctcatatggtggaatgggcaagagagctctctgggccctcttttataagggtactaatgtcaatcttgaaggctctgccctcatgcctaattgtctcccaaagctttcaccctcaaatagcatcacactgtggcttaggtttcaacatatgaattgggggtgggagagacacaaacattcagaccatggcaaaggattttagaagtaaccttgcccagccccctcatcatgtaagtataataatataactaaggtcaaggaaagttgagatttggctgagttgtaagaatttttagtggaccagaaagaattagaactcaaatttccatctcagagcagtggccatattctctgtggggaagcatttgtcagtcatgacattagcaatgatgagacttattcatggttttcagtgatcattgccccaaaaaggcatgttgagtggtacaggcatagatgtgttcaccggcattctgtgggagagcttacttggaatggaaggaactttctgagcatgagtgtgtaacttatgtccacttgttctttttttttttttttttttttaaatgagatggagtctcactctgtcacccaggctggagtgcagtggtgcaatctcagctcactgcaacttctgtctcctgggtttaagcaattctcatgcctcagcctcccaagtacctaggattacaggtgagccacgacacccagctaatttttgtattttagtagagacagggtttcaacatgttggccaggctgatctcgaactcctgacctcaggtgatccacccacctcggcctcccacagtgctgggattacaggcgtgaaccaccatgcccagccatttgttctttctgtttgtcattgagcaagggatattgaaagctctgcctgtgattgtggaccgggccatttttctaaacagtgctatcagtttttattttgtatagtttgaggctgtgtttttaggcgtgtaaatgttccaggctgttaggccctccttgagcctcttcttatgaaatgatctttttatcctttgtaatgttttgctccaaaatctactttaatattaataaagctattccagctttcttttgattaatattaatgtggtgcatttttccatccttatactcttattgaccttgtttgtctttatatttgaagtgtattttttgtaggcagcatgtaattgggtcttgcgttttcctttggattgggaagaccatgtacactgaatgaggttatggatatggttgtcactgaatctgtcatcttgatatttgtttgctatttgtccagtctgttccttgttcttcttttttcctcttttttttttggattaattagaaattttttatgattctattttatctcttttgttggtttgtaagttacaactagtttgttattttactggtttatctcctttgtgggtttataagttataactagtttgttattttactggttgctttaggcttatagaaaacattctaaacttgtcacgatgatgttatgtcagttcaaatgatattataccactccacagacagtactttacaaaagtacttccatttttcatctctctctctctctgtaagcggttgttgtcatactttttccttactacattgttgatgtttttctttaaacagttattttttaatgagttgtaaatttaaaaaaaaaacaacatgtttacccatgaagtcatcattttgggtgctgtaaactctttgcgcagatccagctggtatcattttccttctgcctgagagatttcctttaaaatgtcttagagactgggcttggtggcttgtacctgcaatcccagcaactcaggaggttgagataggagatcacttgaacccaggagttcgagactgcagtgagctgtgattgcatgactgtactcccatctgggtgacaaagggcatcctgtctctttaaaaaaaaaagtttgagtgcacataagttggtgatgaaatctttgtttggctttgaccaaaaatgtcccttttatacctttggttttgaaaaatatttttgctgggtaaaaaatactggattgaggtttctctttcactgcctgaaagatgatactctgctgtcttatttgtgttgatatctttatctttatttctctaaaaataacatgtcttttttttctgtttttacagttttctctatatcactggtttttaacaatttaattttgatatgccatggtatcattcagtctgcccttaattccatctggccgtttttcatcttatcacctcacatactgtagttgttgtatatagaaatttaacctgggctacccccaacacccataatatcgtctgtatcttaacttttgaacctatggaatacagttattatatgaaaactgtttaaatatccatgtttgctaattctaacatctctgtcaactttgaatcaattttgattgcttattattacatgtggcatttccctgtatcattttatgcctcataattttttattaaatgtcggacgctgaatttaaacctgttgaatgctaggtgtttttgtaatattcttgagcttttttctgtcacatagttgagttacttggaaacagtttgatccttttgagctttgcatttttagatttgttaggtgggatagaagcagttatcagcctaggactagttattccttactagtgaggcaagacccttctcagtcatctaccatgaatgttaagttttctcacctgactcgtgggaagaggcattattcctgtccctgtgtgaacaccaagcactgttaatgctaattctttttggtgattttccccctggcttcagtttctttcacatgcatgtacccatcattactcagctatattctcagggatcactctgcacatctctggattctcttttggagcaactctctcctcaccaataccctgtcctgtgaattacaactaccttgatctctccacacacttcatgtcctccactccacgagtcctctaggctctgtgtgggtttccccacctgaaaccatgacctggaaattcagggccatgagtttggcagctgtaagtcctcatttgtttccccttttcaggaatcagtgtccttcacctgatgtctaatgtcttgcagaaatgttgtttatgccaggtgtggtggctcacgcctgtaatcccagcactttgggaggccaaggcgggcggatcacgaggtcaagagatcaagaccatcctggccaacatggtgaaccccgtctctactaaaaatacaaaaaattagccaggtgtggtggcgcacacctgtagtcccagctactcaggaggctgaggcaggagaatcacctgaacctgggaggcagaggttgcagtgagccgagattgtgccactgcactccagtgtggtgacagagcaagactccatctcaaaaaaaaaaaagaaacgctgtttgtatatgaatatattgtccagttattggtggttcaggcaggagggtaaatccagttcttctcactcaatcttggctggaattgtttgtgcattttatgcaacttaaccagaaagtcacccatttgcaccgattttcctcaccattttgatttttctttctatggataaagttacagtgcacagaaagccatgaggagccgttaaagagctcgtggcattcttccaagacgtaagatactatttaccctgttctaccgatgatatcactgcaacctcgggagatggagcggctggttcagggtgacactgctgggaagggagagggtagagccgcgagtcactgtggtgccttctcactagaacgagcttcctctctaaacaaagagcttttgaaaaagaatattcatattagcgttttcattttctatttgccaaaattctctatcttagcaaggcacttgtcaggaaatttttttttatatctctgcagaacaaaagttccttggttcctctcttttttggagaacacgctttcaggagaggagccgtgtgatcatttgccagagaaggataggctggtgggtgctgagaccagaatctttatagcagaaacttgtgaagcgttccagctgaaagtccaatctctaaagtaagatctttgctaaatggacattgatgggactaaaaataagctgagggctgaatggaggctttaacaaatgtacatttaaactctcagtttagtctcatcagccatcacaggaaaggcagtggcaagaatgtttgccgaagtgtcatcttttatcaaaggggataattttagagtggttgtaatcgtgcttattgtgggcctccgcattgcttcatatggaattaggcaacatgttcatttgaaaaaaaaattaaaaactggattaggaagaaatattttactgtcaaaaatcagatcactgttgttgattgatctaaggattcctgttaaattcttaactcggatttatttatttatttatttattttctctctctctctctctttctctgtttctctttctctcctgccttccttccttccctccctccctccttccttcttcccttcctttcctttcctttccttttctcttcccctcccctcttctcttctctaatcttctcttttcttttctcttttcttttcttttcttttgttttcttttcttttcttttcagggtcttgctctttcacccaggctggcatgcagtggtccagtcgtagctcactgcagccccaacctcctgggctcaagcaatccttttgcctcagcctcatgagagttgggtctacagaagctccaccatgtgtggctaatttttaaaaaatttttgtaaagacagggtctcgctgtgttacccaggctagtcttgaacttctggcctcaagcgatcctttcacctcggctttttaaagtgctgatattacaggcatgagccaccatgactcacctttaaatctttcctttgtaataaaatgtggctgggtggtcacaggcctggagtctagggggcattacttgccatttttgttaagttaccatctttaggtgttcatttaagttttaatgttgtatggcttgacctggcacttaggtctgcactttggcaggcacaagaaaattgtaaataccttcttttttttttttttttttttttttttgagacagagtcttgctttgtcgcccaggctggagtgcagtggcgtgatcttggctcactgcaagctccgccttctgggttcacaccattctccagcctcagcctctcaagtagctgggactacaggcacccgccaccatgcctggctaatgtttttttttttttgtatttttagtagagacgggctttcaccgtgttagccaggttggtctggatctcctgacctcgtgatccgccagcctccgcctcccaaagtgctgagattgcaggcgtaattaaatgccttcttgaggacttttataccttcctcttgaagacataaatccagagcttactggtggttgtctgaaaaagatcacatcttgtaataggagtcatacataaatatttctgagatctccctcatacttaaccaccgtgcctggaaaatgcagacaactgtattcagtaaatggtatttgaatataagtaaatcaaaagtgtcgtttccatagattctgtagatgttaccacttagaataattacctgtctaacccttaacaaattctaccgtatattctcagactttgcaaacacgggattccaaaacaatgtggattgttttcagtttctttgaagctcagatttaaatcatacttttactcagtttttaaacctaaacgtggaagtgttatgagatgttgtttttgtgcagctagaattccttgttctactaatgaatttcatttcctgagtccctgtgtctgagtatactgtatgtttcaaatttctgatttagttatgtacctataggcaaatacactgaatggtcaacctaaaaatgcattgtttgactcatatttagagtcatacatatataggcacatgtatttaaaataaatactttaggctagatgtggtggctcacagctgtaatcccagcattttgggaggctgaggtgggaggatcccttgagcccaggaatttgagaccaccctaggcaacatagaaaggccctatctctacaaaaaaaaaaaaaaaaaaagatttttttaattagccaggcatgatggtgcgcgcctgtagtcgcagctactctggaggctgaggtgtgagtgtgaaccaggaagtcaaggctgcagtgagctgtgatggtgccactgcactccagcctggatgacaaagcaagacgctgttccaaaattaaaagttaaaaaatgagataaatacttgaaatattacaattattaaaatagttgttttccccatgggaaaaaaaagttgagcagagctgtgtctttgcactcagaaaaaactcttactctgttgaaggctagtgactcttctaaacaccaaccccttcacctttttactttccttagactttctttggaaaatcaaggagttagcactttttccccctggaagaattaaatgcctctccagaactgcagcacaggaggttaacttctaccacctttggaggcctgcaagctaccagattaaatacttaaagctaagcattcatcatttcttaacctgccctctacagtcatgcacttcctgctttttactttgtcagggctcgtactcaaactattcatagcttcatgaaacaggaactaaatgctgtctgagcctttccccttgtaactctcagcgttctgcttatccttcatagacagaagatgatgatatgtcctgactgttgaagagaaattagacttaatgtgatcctgtacagttaaaccaaaggccagatagggattttttatttcaatcaactttctattgtaggcctaggtttggaaaaccttagcaccccctaatttgtaagacttgaactgttttaaagataagggatacacagccaaagctttctttgtaattctgagatttttggtgtttttacagatacttagtctaaatctttcatcagacagttatcatgattattattctgacttcaacaactgcattttctaaagggaagtgagaattaggaaacattttcctgtacatctgtttatctatcccagttgtgttgtttggattttttcagtgtcttaacgattgaaaccatcttatccatactgaaattcatttcatgcttctatctgctgcttcacattcaggctatcagtttaattgagcaaaaaaaaaatgttggcagtttctatagcatcggcatccttctttggtttctcatttttgaatggttcagccacatgttaaattttgctgagatctctggaaacttcttcacataattctttgatagaacatgaattctgtgagactcttcattaaagagcacggtttcatcactaagttgagattttgctcaaggctatttggtaaattccagcagaagagcaataaatgttcaacaagaaacagccgtcattggagataacaagggtagacattaatgggaggtttgtcacaggtaaacaggtgatggcatgagaaggtttaaaccacctcataaataaatttttcgccactatatgatgtggattacaactaaaccaaactttaaccaatgtgggtgttggtgtacctttcttttctaaagcaaaaaagaaattgtggtactaaacttgagcttttatatgataccgctaattgcccttcacccaacaaaccaattatttctacccatcacttttcgttgcaaaagaaattatcttataaaatatatgtatatagcatatatctccaaagcaaatatgggacatctgtacctcaatgtaactgatagtaagttaaaaattatttgctgagttcttggtatgtggacagatgaatattataatgtttaaggcattccaccagcaggttttgaatttaaccaaaattttatgaagctaatcagaatggaattaaaagttgaaagactgccaggccaaaaagatcatctttcagaaaagtaaataattgctctatacttacatatttattatttatttgttcaccatccgtttatttttagttgagttctgtatacattggtgagcaaagggggactcattagcttgggcactcctaagggcaaacccaataacagatagtgaatgggaaggaaaatgagagaattagcatttagtgaacaaaatcttataaactatgctgaatggtatacatgctctttcagtaaagccactcagtactattacttccctaccttctgaatgtttaccaagttcgataaaatcttgctacatacaaatgggaagtatgtaacaagagatactagtggtttctgggtttaattaagttacatagaacattaagaagtatgttgggaaggcattagcttaaaagctgtcttttgccactgaggccatattcatcacccagattccctccacagtggagcactgctcagtcactgccttcagaatgcaaataggtcttcacaggatgctattaaaacccatagcaccgtatggttttacgctctgctttcttccagcaaacctacgtattttaatgttaatatatatgttcattttatctttgagaatgaaaatgtattatgaaaatataaatatttagtttttgtagacaaatagcacatttaaagatccagtagttattcacctgcctggtatgactgatagagaacagatgggtagcaaagaatcctcaccctggaaacatgtacgcatacacacgcaaacacaatctcgcataagctttaaggggttcattcattttgtgaaggttgaccatggataccagtttaaagatgccaggtgatgtttggcttttaagtatcatcaccttgagtttccttatataaatgttttaatatcaacaaaaaactcagaatttctaataggtcataacactgcctaggtatgggaagaggagagggtaaaattaaaagaaatgcaaatgtacttttctttgaataggctaaccagttagaggatgtatgaagcaggaccaccatagtccaagtatgaatatgcaaaattaaagcagattgctgtaaatctctcttaaaaagtcaagaatatgtcacagttggcatttttcggatgatcagaccgtttgacaaatctctgcaagggtccgagttagtcgaacatatcttttgcttatgatttcagcaacactgtgcgctttgccttctgggttgtattactaattctgttcatcattaagtgtacacatgtttcactgtttgactaaacaaagcttgaagacatacaagtccaaacattttctgtcctttctgtattcccaggtcagaagatcttagctctttatccattctgtgctagagtttgtctgaaagcatgaatcatggggttgtgttgggtgctaaatttcagttctatatgctgccttcactaatttatgactgtggtctgaacaaccaaaataaattatttctgagaactagcaaaataccctggaaaaaatttatgaaacctaccagatttgtaaaaaggtcagccaggcgtggtggctcatgcctgtaatcccagcactttgggaggccaaggcgggtggatcacctgaggtcgggagttcaagaccagccggaccaacatggagaaaccctgtctctactaaaaatacaaaattagctgggcatggtggcgcatgcctgtaatcccagctactcgggaggctgaggcaggagaatcgcttgaacccgggttgcagtgaggggagatcaccccattgtactccagcctgtataacaagagtgaaactccgtctcagaaaaaaaaaaaaaaaaaagaaaagaaaaaaggtcactaagtgatgagagaattaaaaccactcctattttctaccttttataacataaactcttgtctttacttcccaggtttgccatctttataacctgtaactaggagcaagtgatttaataaagggattcctcctattccgtctgcaaattggagttaatttttctcctctttctgcaatttctgttgttttagcttttgttagccataattagaaaatcaaaaggattcattgaaagttgagacaaaattgtgaagtaggaagatgtcttcctccgtaagaggagaaagattgttagaggaagtacatggaggctttggtgacacatccctatgaggaagtgatctgcttccacgggaaggagagaacagatgatagatgactcctagatgctcctgcgtcatgttcagtacaaaatcagagccgcatcagcaaaccggataccctgggaaggaacattgggataactccttggccataaacaaaagttttgctctggccttatgaactaagtggattaatagagattagttgttcaatatccttccatctaatggatccatattgttaaaacttaagaaacaccaaagggggagagtgtgagaatctactgccattttctccattgcttcattcaagacttctgtgtccaccttggcatgggattatcatttgcccttttatactcaccttaaactacaaagatcatttgtttgcctttctgaagaaaggaaggtggataaattttgcaggagactttaaaaattcagctcaactcctggcattaaagacaataaaggtggtgattcagaggtccccatggcagtttccccaaatattacgtttaactaagatcatctcaagcacagagagacttaactctctaaagtgtgatttttaaacctgcacacggaaattttctacattttatatgctcaagatttcttgaaatccagggtgtaaaactgtgaaaataatagttctgaacctatttatgaaagcaggagagaattgctttgttcagttttggaaaccaccagggtgcaatttaatgctccaggagagggttttctgtgacctggaaaggttggggtgattcccgtacagtgagtcatttacttccttcttggcaggattatgcccagggcttttaaacgctcttgacacttcactgccttccataagaaacgggtttagggcacaagtgtctattatgataagatgccagatttctagatcaagcataaagctgtggagtgggacaataggacttaataattttaatacacttcccacgtgaactgtcaagtaataagctacatattcagacgtgactggcattgagtcatcctgccattagtcaaatgtatgagacttttcccaagtcccagcaacaccaaatttgagaaatcgtataaaagaaaaatgaaaaagtaaatacgtctaagaaatggggaaatcaataaaaaatgtactagcaccaggggcggtggctcacgcctgtaatcccagcactttgggaggccgaggcaggtggatcacctgaggtcaggagtttgagaccagcctatccaacatagtgaaacccttctctactaaaaatacaaaaattaggtcggtgtgagggtgcacgcctgtaatcccagctgaactcaagaggctggggcaagagaattgcttgaacccaggaggtggaggttgcagtgagttgaggtggaggtgcaccactgcactccagcctgggcgacagagtgagactccatctccaaaaccgtgttagcttttatcaggaaaggccattaaattttcttcaatattacctacatcaatttgacatcaaactataagaacacaatatgtgagatgttttgaaattaatgaaatgaatcttctctttgagacgagtttgtgcacgctatgaagtccattaaatattttctgggaagagttcccagttaaaactactttctaaagtacccaagcacactatatagatacatcaagtaggtttattaatgtcagtatttcggtgaaaattgggaaggccactattctgagtagagaggtgtttgttttctacttgaagactatgaaggatattctgcactactgggcctatttctgaaattgtatctagctgcaagttactcattaatttaattaacaaatatttattagcaaccaaattgtggcaggaactgtgcctagaggtagaaatacattacgctcttgtttccagagaggaaaatgagtaatgttctaaaatgtaaatcttatgtttctctttcctcttgctgtaaatgatgtctaagccatttcggtggtgcctgttcttaatcctttaataaattattttgaatgattttttaaaaggcagtgtgattgtgaggtgagtttagtacaaattaaaaaatgtcacatcagttgcaaacagacagcacataattatgagctaaacactgtttcagaaacagtagtgacaataaataggattcggtataattagtcctcctgggacagatctcttcctctgttctttgccatatattttaataatgagattagccatctaatgccaatataaccagactgtagtattaatacacagaaaaattattgctagtaacagaagatttaaagacatgagggtgatccggattatatgcctgcaggttaaaaaaaaaaaatgtttcttaaactctctttatcaatatccttttcgtgagccactgaattcttttgtttttctgatcatatgaataacccgtcttaagtatgaatattgtgacaatagtaatagcaattactttaagagaatatgtttctatagagataacagaggggtttttccctaccattcctgtatgaaggtttctgtgtttttaattaaaattttaagaaattcatctttgtcttagcataataaaataaacctcactagacaatcaggacaccttgttattcttagatacattattatagctcaagaaataacaaatgttaagcctggaggatttgtattttggccaaaagttgtgagggcaattatttatttatttgagtgaaatatgcaggaatcatatatcaaaaggagggaggtcttttttttaacctcaacaaaaatataaaagtatagggaactgttatctatgtgaacccagcaaatctgagacaggtctcagttaatttagaaagtttattttgccctggttgaggatgcacctgtgacacggcctcaggaagtcctgatgacatgtgcccaaagtggttggggcacagcttagtgttatgcatttttagggagacatgaggcatcagtcaatacatataagaagtacattggtttggtctggaaaggcgagacagcttgaaacaaaaagcaggaagactcgaagtggggaggggccttctaggtcagagataggtgagatgaacagttgcattcttttgagtttctgattagcctctccagggtagacaatcagggtgattggctctaagcagttcccagctagacttttccctttagcttagtgatttgggggccccaagaattattttctttttacacctgtgttttttctttcttaactaaaaatagtatttgtttctgagggatagagataactaccattttatttggtatgatttatttgcctaccgtccaacaaagaaggtaatctgattttgttttcatttccaagcatgattcctagagatgtgtttaggtggccaaatcaatgaagcagaaccctgcaaattcatttattgggagatatcctaaggtcttcctgaattatctgatgttcccaggctttgcttatccaataggcattaggaagaaaaggcttgtgtttatgtagatgcacacaaaatgcgcatctcagcttacataaacagtgaaggggtttcccaggtctcattatccctggaggagctgaggcctggggagtcctcagagcctcctttgctactctgttattgtggcaggccaaatctcactaatgcaggcctccgtaacagctgtttccgtactgactgagtggttcagttaaatactaaaagctaaaaaaaagccagcgcccttatacagaggctggaatgtaacaaaagcccaccaagagttttgcctaggcctttcctggcaaaaccaaggaattcttaacaggacccatttaggattaacaagttttactgggagtctgaagaaactctacaggcctccaagaacaagtttactggaggtctgcaggaactcctcaaacctccctgatttagcaggagacaagataagagtaatcaccccagcacctagacccatttagattaagtaaatttactgagactccagaggaaggtcttcaggactcagaccttagttatggattaaagaagttaatcacttctgtcatgagatgaatgcacacttacacgtagacatacagcttagaaggcatataagttctggaaactttgtaattttgagttggtctggcactaatttccaggccatctccctgtaaaaggttacaaaaataaaaactctcttcctcccagttcatctgcatctcgttattgggctgtgaggtatagtagcccaaccctcagttcagtccgggaacattattatcaaactctggggattttcaggataagttaggaatatattttgaaggagaatggcagtattaaatgagatcagcaattgaaaacatgtgaatacattcaccatttaattacccatctcaatagaagataaggatgaatttagcactagaaaccatgaatgtcacaaaagcctaactttaataccttgaatcactttccagtaatcctaatcctttatccacatggatagaggacattcctatcttgctctttcttctccccacacattagcttaataattagctaaataatttcatgcattagctaaggaataatggaactccagaaacctaggacagtaattgagagactgaacaagctaaatctgaaccttctgcacaattaaaggagctgatgttagcatggcccacagaatattacctgcacttgtaaaaactagaaagtcaggcaagtactcctggaacagactgtcttttctaaccatgcacttatttctttgtttttaactttgtttttgtttgtttgtttttgagacggagtctcgtcctgtcgcccaggctgtagtgcagtggtggaatctcaggtcactgcaagctccgcctcccaggttcaaacaattctcctgcctcagcctcccgagtagctgggactacaggcgcccaccaccatgccttgctaatttttgtatttttagtagagatggggtttcaccatgttggccaggctggtctggaactcctgacctcgtgacctgcccgcctcggcctcccaaagtgctgggattacaggcgtgagccacggcgcctggcctgtttttaacttcgtaagttgctttgtagaactatcttaaacttggtctattttagattctccttgaagggccagatcacaaagtgattaggagaaggaggctctggagccaagacagtgagactaacccattcttcaaatctaacactaactagctgtgtaaccattgggccagggatgtagcctatgtaaccacaatctcctttgtgcttcatgcctcaccaataaggtggggagagctgctatgactctgtcatagggctgagacgaagatttgatgagttaccagcaaaaagcatttaatatactgtctcattcagaagcagtcaatacacattgaactcttattacttagaggaaagaaaggggtcgatgatttatagataaggcctgagtgaaagaaataaatgtgtattgagtatcagcaatggactacgcatcattctgggtaactatcactgaacacatttaatctgcaaatactatctgaaagatactgccatctgaattgcataggtgggaaaagtcaaggcttttgtgcttatttttaaatgtatgttaacatgaataattaattggccgtgcactggtcgcacgcctgtaatcctagcactttgggaggccaaggcgggcagatcacgaggtcaggagatggagaccatcctggctaacatggcgaaaccccgtctctactaaaaatacaaaaaaattagctgagcatggtggcacgtgcctgtagtcccagctactcaggagactgaggcaggagaatcacttgaacccaggaggcggaggttgcagtgagccaagatcacgccactgcactccagcctgggagacagggcgagattccatctcaaagaataataataataataattagtgggaatatatgctgtttgttgtgataggagaagaaaaggggagatccagatgttggtcatcagaaatgacctgcatcttctctaaattgaaatttagcttgaagtagtaatgccaaggccagcctggggccatggcatcctggtgtacctgcttgttggtgacagtccttttaggacaaaatatcttacaaaaacattcatagatgactaactggaaaaaaagaagttatgatgaaaagcaattcttactgtttttgttttttgttttttgttttttttaattaaaagacaggcagttattctctttcccaggcttgagtacagtcgtgcaatcagggctcactacagcctcaacctcctgggttcaaataatcctcctgaccaagcttcccaagtagctggaactgcaggcatgtgtcactgcacctagctaatttttaaaattttcttgtagagacaggttcttgtaatgttgtccaggctggtctcaaactcttggctgcaagtgatcctcctgcctcagactcccaaagcaatccttacttttttaattgaagtgctttttttttttcttatttaaactcttaaaaattcatcccattttcttcaaaacaataaatcctttacaagggagaaaaatgaaatagagcaactaagaaagcatccatgaaggccaggaaggaacatcatggttaaatgcgattagtcacagccccttctgtctccagtcttggatgaataatggtaacagaactagagagatttctaagaccttggtgcttaataacaagcaagcatcgagggtggttgtgcaagatcctgatcacacaactctgcatatcaaatatccttcacaatcaacaagagtcagcctttaatctctgatgttttcaaatgttctttttttttaattcacatgtataacctatcctcttttcaatatatagagatatagcttatcagtcattacctcttttactacttttcttctgagatttaaaaggtcatcctctgatttgtaaattcaaccagatttcacagttcagatgagagttgtaataagttgccaagaactgttgcaagctgtgatggctgtctttctggggattatagagaagcacatttcttttaggaaaaaagaaggcagatgagcccaagttgttttatttttattgtgtatatgtatttgttttctcaagtacagtagcatggcctctgtggcaggcattcaccaagcaaatacagagcaccctctgggtcaagcactgtgttattggggttccaaataaagaaaaaagaccaaatccagccctgtggatctcacattaaagaggggagtaagaatcatagataatttaatgagttaggtacattaatggggatttgcacagtatttcataggagcacagaaaaagggtacctcgttccacctgagatggcagggagatggctcctaagttaactaagcaaaaggggaaggagaggcacatcccataggatatggataacacaacaaaagctccattaccacccgccccaccaccacacacaccatctctggaataaattttgtaccttccaactggttttcagggtactcatgacacatgggttaataatagctaggtttgcccaaatgaccaaaattctattcccaacatgaattttcacaactggtttttttgtttgtttgttttaatgaagaagaaatgttgtgtttttggaaatcatcttacaaaatcatgtagtggaatgcatatagtgatgaaattgttgaagaccagggaatctttgtccttagtttttattaggatggatgttttcaggtaaaactaaaataaaaatgaaatggaaccaattagaaagaaaataggagcacttaagacgaaatgtaattgttgctgaaagaattagaatctgatagcttagaaagaacttaattaaatttcagagtaaaataaatacagtttagcaatggcctttctcctagaaaaatataatgtctcttacagttcagttactccttggcttacaaaatagtggttaaatttcctgtttttctcattttgatttcgtatgttacatgttactggtgatgggattatctgtgtgacattacctctggtcttcaaaatgtacacgtagcaatgtagtctcacatatgccccttgggtgcgaaaagagaaggacctaacttaacctgacagacctcaaatctgttctctttctatagcagagtactcctatttaaaaagaaaatgttgagtaaggaggacagtcatcatatatgtcgagaatgttaaatgctcttgtggaagtgaaaagcagccgatctaagtaattacccattaagaaaggagtaggagaaatgtttagaaggcagacctgcaaaaaggtgactcacagtacgttcacatgaccggatgcattagtggaacctctaacccatcgccaatggaagaagcagtgttttgcacaaacttgaaaaagagtttttcattttcctcccacagcctcgtcacgtgttcaatatgctaaagaagtatgtccgcgcagaacagaaggacagacagcacaccctaaagcatttcgagcatgtgcgcatggtggatcccaagaaagccgctcagatccggtcccaggtaagcgtggggtataatcatcttctgcagctttgacaatccaggattcttgcttcttgggttggtgacaggatcccacgcattctccgagcacctataggtgttttccctatggcaagagctctttaacttctggtaaattctaaaagcttgtcttagagcaatatgtggtttggcattttctgagttatgaaaataacaaatgtaaaaatcttagtctactgctaactgattgctaaggaactgattaaaaccaatgactaaaatgagaaaaacaaaagttgtataaactaaaatcttgaaaactggttcaactgaagtatggcaggcaatcataaacctactggaatgttgagatttcatgtgagcctaaatgaagcccagtaataatgtattttatactccccggttcccaaaggctgaaaactgggatctaccttaggaaatgtgaaattttacattttcttgaatgaaagagttaaatatatatagcatgaaatagccaatcaaattgaaatacgttgttttctagggggaaatttgcaaagaaatgtatttaggcatgagggtcctgttaagagagcctcagtattaggaatcagaggtggcagaggtagcctttttaattggctgttataagcatacaagataatggtaagtttcaagatcaagtcttaaacctgagctcaaaaagttagagaacagaaataggagaacaagaaaaataaagttgccctttcagttcaacctttttaacagtagcagtgttttgtcagttttcttttggaagtttgtatctacctgcagtgcttggtaagaaaaataacctgggcgacagagcgagactccgtctcaaaaaaaaaagaaaaaaagaaagaaaaagaaccattcctacccccagacattgttgacctggagttgtcatcctttgatgcaggttatgacacacctccgtgtgatttatgagcgcatgaatcagtctctctccctgctctacaacgtgcctgcagtggccgaggagattcaggatgaagttggtaagtaagctgttcttttgatgctgcacatggacatgtattttcccccagaggaaaattgaggaagtgagttatctgtttgaggaatatggaagttaatagaacagcttgccttttacgatgaaactgtcaggctggaactagcttactagccttagcaattgaatcagttcttacctctccatacttgtaagactggaggaatgtcgcctgacttagggtatagttttgtaataattggacacttgttattgaattatacgtggcagcattttttctaatttgcccaatcttgttatggctctcaaattatgatgctttggtactttacaattaatggggaaaaaaactcattcttcatcttttgagtgtcacgattgttccatcttacaaatgaaaaagctcaaacttaaaatttgagtaacttactggcctgtgtcacatgcattataagtagcacagccaaaacacataactgtgacttgtgactttgaggttattgttatattcagtaagtcacaattctctttgatggctgagcagggaagccatgagtgttctctgaaccacatcattgtttaaacttaaaagatagtgggctattaaacttatattctgaaataattgtactctcacaagaacttggaaaaatagtacagagaggtctcatgcatccatcacccacatgcctcaccagtgacatcttacgtaactatagtccattatcaaaaccaggaaactgaccttgtgtgcccactgtcttttatgtccctagttttcctaatgactaatgatttcatttaagatctctcatttctgtttctcttggaaagagaataaaataccacatgagtctctgtcagctgccaaaatgcccataactgtttaacttacttcacaaaggtacatagatgacgattatgttggtgcatctttcaatataagcatatgtacctatactggagatttagtgtgtagtctaccaacatataagcaatatgtatctggcatatccttccccataaagaatcctaccctttgttaattgggttggaaatagatacaggttatcatctggaatcagagcacccaggatgttgtagatggatgtacccattacagtaagtccgactttgaagtgcctgaaacaccgctcaagggaacagctggccctcactttttcccattttatgccagtgttattctgctcattctttcctgatttatgtggccttgtaaatattgtttgtattgctgtgaaatatttggcatgtgtcaagtgatgatgttctgttcagtactgcacattaatggacggaatctgaaattatactttgagctacataacttgcagaagaaacttcatatgtcagggaggtgcagtgtcccagaactttgggaggccaaggtgagcagatcacctgaggccaggagttcgaaaccagcctggccaacatggtgaaaccccctctctaatttaaaaaagaagagaaaaaaagcaacttcatagtgtgccaagcttttgttcagaaggagcaactcagtgttgagcaagaatttatgaagatagtggaggtggagtttttagtctacaccatgaattgagaacagagatctccaattaatttttcactgtatcaagtttctttagcaaacaaatatacttttcaggtatacttggagaatagacatcagtaaggaacctttaaaatactatgtattaaataagtgtaaagaagttctccaaaaagttgtagaaggtacaaaatgaaataatttatcagtcttaatgaactgaagctaaaatcttctagaaaacatggtttgtttgtttgtttgtttgttttttacagctatcttaagcctgttttcacatgtgacttcagttgaagtggcataggtaataactatagggaaataagccattacaaaggactaaaaagttgatgaccaatattccaccctcacccagcaattattgttgactctttataattaaattattagaactttttatttggcactatactactgaaaacattagccactaattagtcacacttccacagaacagatggtggttcagatatcttgaatattacgaaatgcccaagaatagggcagcacaataaacttcaaatctcagtaccagggaggatatttagataactagtatcatggaatctttttctgtaaaaagaaaaaaaaaaacagccattaggttggattaagaacatattagggggtgcagcacaccaacatggcacatgtatacatatgtaacagacctgcacgttgtgcacatgtaccctcaaacttaaagtataataaaaataaagaacatattacgtatgtgctcttaatgtgtgtgtgtgtgtgtgtgtgtgtgtgtgtgtgtatgtatgtaatatgctctcaatccacccattagttgggtttttttaagtaatgacatatatatcattctaaatataccagatgccacattctgaaagataatcttttttaaaaacctttcatttggaatcctgggtgcttccatttttaaatgactgttctctatagaaagagaagtttgcaataacgaaccctgtacactatctgagctgctagtgtcaaagctacagaagtggtttgctggggagaatagcttttctgggttgaacctagttgtcatctatagtcctttttcatttgaaggaacatttaaaacaatacgtccctttttagtaggaatatagttgaaacttcaagattggccaggggtgctaattgcttaagccaaatgttattagaggttcctcatgttattctttttacttttgtatgtgtttaaaatttctcataataaaaagtgttgcttttagcttactttctaaataggttcttcatagattttttttccaggttatgtcttgtagtcgttctaatattctctgattaaatgctttgtcattagtctgagttgcatttatttgctatttctgtatataatcaaattttagatttggagtcagttcagtacaaatagcatactaaaattcagagacactggcaaaaggagaaaattttaaagtccctaaaaatgcatgccttttgtatagaagtttgtgcttataaatacaagcaattaggatgtgcttaatgcagtcaaacatctgtagagagatacaatggtttaattaaataatggtaacagttgctttatggataagaggttttcaccagtctggggaactgccagtatctttagtgggagaggtatatctgcttcagtaaattatgcttccaattagaattctcttttatgggtgaaaatgaggaagaatggagtcatgctgagaagaaggaatgctatcggtgaaggggaaaattgacattaaatttgtgagcagtaaactgtgaccagagcatagggttcatcatgcttgtgagttctggccctggccttgtatcttccattgtgcttccctgaggcatcctgtctgttcatgctactttcccactaacttcagtgaatcccaaattcatgggtctagccacagccagcgtactgaatcccagtgccatattccagaccccaaatatcccatgtgcctctgaacctgcaatcaatgtgtataacactcatgtccttctggaaatttacttgttttacacactctattctgagttctcttggttggcctaaactatccatgatgccttcctctccctcacccattatttcttattagttgcaagttctgtatatttggccttctgtgttcatgtgaaatctctgcacatcccctacttacctgagatcctgtcctctcatcagtgtcattagactcccagccagtcaccctacctcttatctcacattggccccctcccacttcaattcctccttttcggaactatgcaagttcccttaaaaacaaaagacaaaacaaaaaaaacagctgcaggccggcggcagtggatcacctgaggtcaggagttcaagaccagcgtggccaacatggtgaaaccccatctctactaaaaatagaaagattagccaggcatggtggcaggcacctgtaattcccagttactcaggaggctgaggcaggagaatcacttgaactcgggaggcagaggttgcagtgagccaagattgcactattgcactccagcctgggcgtcaagagcaaaactccgtctccaaaaaaaaaaaaaaagaaaaaaaaaaagctgcttgtggtttttccttgcttgaaaagttgcacctttcaagattcaagtaaaatgcccaagtcctataaaccctttctaatttgcatagagaacggagaaaagagctggcatttgagtgacaaccatgtaaccaactaatgagtgcctctttgtgataatgctgatggtcacattctttctttatgaatgttccccgttgaggtacaggaccgccatatagagatgtggcagtggcaggtggtttagggtaagagtggagactgataattttattctacatcccactcaaggagccaagccctctggcattgtgcacacccactggaagtgggctgttcttgcatttcacacaaaggcagcatatgggctagtgaagatactcggaaattcagtgatagcatccccagtttacagttgaagaaattgaactttgaacctaagagagtttgccaacttgcccagcccagatagtaaagtgatgaaagtggggtggaagccaagacctgccagaagtccaaaatctgtgttctttctgctgcctattttcctctctgaagtggaattttcccctacttaacctcaatgtgaaagcactgggtatccacctccaataccatactctaacttggagtaaattatttgtttatatctctactaaccctccatcctgtgaactcttccagatatatgttggtcatccttgcctcctcaagatccagcaaggaccctggtactttttagatattagtaattataaatataaggttgaagccagtccccaggataaaaaggcagatgctccttaacttggactgatgaagtgggctcctccgtaaccctaaagacctgaccaaaactccttccttgacatctagcgtaagcaccacacaaaacaaatttctttcctaggccacagcatcctctaaagctgtgattgatcaagctaactaaatggatgtggttggccaagataacaaagcataaatcagggttctgaggacctttattaataaaattttacaacatggtccttctttgtaccatgaccctctgctatttggtcatctacttgatttaattgtgctgtcctgtttgaccgccaaccacagtctgaagctattcccatgacaaataagtgtgaattttcaagtgtcctgttgtgttataaaaggcccgtgttttattttataatttcatatttttttcattcaattttaattattatgtgcaagttcccaggctcagtcatttattaatgtttttattttttaaaaagttattttcaggcagattatgaagatttcttgcaaagaatggcctcaggcattgtttgtatagagataaaatctcctcttttaaatcactatgtaggtcttcattaatattttttcattcaacaaacgatggaatcattatttcagtgaaactatggctcctcttcagtgttcatattctgctttaattatttattaatccttcaaaagggcagaatcccttcatcctttcaacctttgctttgtcaaattgttacttaaaaatgattggtgttttctttgtcctttgtaatcttccttaaatctctgctaaaaggattctattctactctttgtattggcactgaggttatttatcaaagtgtgcttctctttgcagctacctcaaggctaaaaatgtagctcttttcagagatggctgttttacagaatgctataataaccaatttatgagaaaggcagtaggaaataaagagggaacaaaggcataattgtttcatacccattttttttcttctagcattcaaaattaataaaaacatgaattattataaaccagatgcgggaaagatctctggctgaataaatccatagtgaatggggcaggattgaaagatatggcggggaatcaagaaattcgcaataatgaaaggatgcttattttttattacaattttactgtggcctcttgataaaatgttccactcttcaggaaaaatgcagcatggttatttcaaagacagtgtttccatattctgtttctaataagcctgttgatttgggggtttagtgggtccaaagtagactaggtttaaaatagaatatttatagcacttcccagcccaacaaaatagaaatttaatgttattgagaatttcaagtatccttatgtgtaattgttagtcaaggatgaacatcaaaaaaaaaaaatcataacagcaaatagagagctgtcactttgttcttataagaacataggtgtgactttgtttttcataagaaatgacttttaaatgtatatagatttaatggtttacagctgacttaagtatttggacataagaactttttttttttttttttttttgagatggagtcttgctcagtcacccaggctggagtgcagtggcgtgatctcggctcactgcaacctccgcctcccgggttcaagtgattctcctgcctcagcctcccaagtagctgagactacagacgtgtgccaccacacctggctaatttttttgtatttttagtagagacagggtttcaccatgttggccaagctggtctcgaactcctgatctcaggtggtctgcccatcttggccccccaaaatgctgggaatacaggcgtgagcccccacatctggccaagaacatttatacatattatcaacaaccaaagccttgttcccccattggtttcataatagtctcagagctccttattcatattttccctagtgttattaagtaacagacatgaggcctgtaagtttagctgcctgtgtctaaatgtatatctttgacccaagacaatttctctttcaaaatagaaccactcatttataaatgaaaatgctttgtcaaatgaatggcaaagtacggtatactattaagacagcctcctagttttctgacatttggactgccatgttgaaatgtctccacacagcaagatacaaatgtgtgaatgccagtacacttcataccttaggtccccaactggtctgtctgcagacttgaggttacagacctgcaggtgtcgaactcaccccatagtggtggttagtagagtgctttgtatacgtttagctctctatgccttttttggttgtgatattaggtaagctctctttttcttgctttggagcttaattatggaatctgtaaatatagtgcatatgtcatccagatgatctgtggaagtcattgataatgacctttaaaaattcacatgtaatacagcatccgttttcctgaatgatttttatagttttaccattggcaaacagatactttcttttatgtatttctactccataattttaggaaaaagtaaatccttttagctacattaaaaagaatacactttctaggaataatgaatgtaaaaaaagtttccttttttaaaaaaatattgcgctctctaccattctggcagacaaattgttgaccttaatatgtataattcagtgcagtatattgatcttgtttattgtgctccaaatggacgctggcagaaatttgaggaattaaatatcaaccacagtgttttcttcatgcgattgcaatggtttgttatggattattttgttcagttcaaataaatgatgtacgttcagattctttgcccaattttttaattgggttgtttaccttactttcttaattttatttttatttttatttttatttttatttttggagacagagtcccgctctgtcacccgggctgaagtgaagcggcatgatctcagttcactgcaacctccgccttacggattcaagcgattctcgtgcctcagcctccccagtagttgggattacaggcacatgccaccacatccagctaatttttgtatttttagtagagacagggttttaccatgtttcccaggctggtctcaaactcctgagctcaggcaacctgcccacctcggccttccaaagtgctaggattacaggcgtgagccactgcactcggcctgctgttattattgagttgtaagaatttttatatattctggatactattaaattcttatcaaatacattatttggaaatattttacccattctgtaggttgtattttcacttccttaataggatccttttgacacacaaaaattttcaatttagaagtctattttatcagttttttcttttgtggcagttactatggtatggtatctaggaaaccattgtccgaaacaaggttacaacgatttatacctgttaccttctaagagttttgtagttttagctcttacagttaaatctttgattcattttaattttcatatatggtgtgaggtagaggtttgactttattcttttgcatataaatatccagtgtcccagcaccatttgttgaaaaagactattcttgccaggtgcagtggctcatgcctgtaattccagcattttgggaggccaaggtgggcagatgacttgagcccagaagttcaagaccagaatgggaaacatggcaagaccacatttctacaaaaaaattatccaggcatgataacatctatttgtagtcccagctactcaggaggctgtggtgggaggatctcctgagcctggggtggctgaggctgcagtgagccttgatcacgccacctgggcaatagagcaagaccctgtctcaaaaaaaggaagaaaaagactattatttcccccattgaatggtcttggcactattacacaaaatcaattgtccatagataatatgggtttatttcttaattcttagttcttttctttgatctgtgtgcctgtgcttactgtagtaccacactgttttgattattgtagctttgtagtaaattttgaaatcagcaagtgtgagtccgttatctttgttcttctttttcaatattactttgagtatccggagtctcttgcattacaacatgaattttaagatcttcctcaccccctgcccccactaccatttctgcaaaaaaaaaaaaaaaaaaaaaagtgcggattgcattggatctgtagatcattttggggaatatttatatataatgttaatgaggttttaaacaacacttttatctactagaactgatatttgcctcgaaatgattccaccttgagccccattcaggaacgttagtattttagaagtagcaagagaactgatttagcatgctatcatcttttactccaaattttggtgagattccagagaaattatttgtgagcttttccttaagccatgatgactgacatgtcagtagtttttgtctgtttttatgccattcttttatttttgtgcatgtgtgggcacctcaaccaaatggatggagcctgaggcatggtctcccacgccaaagtctgccgtttcttttgatgatccaatgcagttccaaagctattttctcaactcaccagctcgtttgtatggccctgtaatttgaaacaaaatctaaaaagaaatccaaattaaaatgattgggaagtgaagtcagaccacagtggtggctgtggaactacttcctggcatggaacactagagcagatgtgtcctgctttttttgtagagtcttgggaacaaccaatgattttagactggaacaagggctggttattctgtttttcacaagcatctgccttcaaggttcattttttaaaagaggaggggaaaaaaatcagtgatgtttgccaccctgagtatggagatgaatccaaattgagattaattttgaaatatgtttcccgaattttgagattaattttgaaatatgtttccacaaacactaactgggaatgacatgagtttgtttcatgtgagacggagtttggaagacatgttaatttgcttgttggtgttcaactcagaaacaaattttgcatgtattttctgagtaagtgccattattagttaacagttttcctgccgtatgcactatgggctgctttagaaagtaaatcatagaaggttagttataatatctcatcaaaaatagtggatccatctattaaccggttccaagttatgagacgtgtccaaaggaatgttgacttggtgtgcacctaaacactatttgtgaagaggctttggacttcgagcatgaaacggggtcagagggtcaaggccagggcgttacttaatttcagctcctgttgatggattcattgacttcagatagtgcgtttaaaaaagcctgtttaatgtgtttgtcttttgataattattatgtatttacatatgctcctaaaagcatgagttaaatcttatttctttgaaacagtgcttggcaacaacttgtattgtcttgtacatgccttttgtgtctttgcttttggttgggggggggcattgaaatttgtctgcccatcccctgagggcagatactgaggtgtggacctatgtcttcagcttcctgtatagcattgaagttgctatagctgcatgttctctaaaatttttatacatgcgatttaattgttaaagcttatgatttttaagtatagtattctgatagcaaatagattttgtcaaataaaaactaactttatcatcaccactgagatatcactaggtatatggcttagttctcagtcaccacttttatttgtaaggaagtcttagaagttttcacaagtgtatatgtgatagactgggcacagtggctcacgcctgtaatcccagcactttgggaggccgagtcaggcaggagttcgagaccagcctggccaacatggcaaaaccctgtctctactaaaaataaaaaaattagccgggcatggtggcacatgcctgtaatcccagctactcgggaggctgaggttggagaattgaacctaggaggcagaggctgtagtgagctgagatcctgccacttcaccctagccagggcaacagaacgagactccatctcaaaagagaaaaaaaaaaaaaagctgggtgcggtgctcacgcctgtaatcccagcactttgggaggccgaggtgggcagatcacctgaggtcaggagttcgagatcagcctcaacatggagaaaccccgtctctactaaaaatacaaaattatccaggcgtggtggtgcatgcctgtaatcccagctacttaggaggctgaggcaggagaattgcttgaacctgggaggcagaggttgtggtgagctgagatcgcgccattgcagtccagcctgggcaacaagagcgaaactccatctcaaaaaaaaagaagtatatatatgatgcttgctttagcagcacatatactaaaattagaatgattaaagagattaacctggcccctgcacaaggatgacatgcaaattttgtaaagtgttttatatggaactttacttacatgaggtacctagggtagtaaattcatagatacagaaagtagaatgctgattgccaggggctgagaggatgagggactgtggagttagtgtttaaagggcacagaggttcaatttggcaatattgaaaatagttcagtggggaagatggatggccgtgatgcatcgtccatcacattgcacagcatcgtgaaatatacttaataccctgagcgttacacttaaaatggttaaaacagtaagatttatgttatatatatttaccatgataggatatatatatgtatattcatatcattcgccattgtgaatagcaaggagattgaagaaataaggacacaggatcttcaataaatatgtattaaatgcttcccatgttccacattctttgtcattgccagacacgtcacaggtataagggcccaatctttgttactcaaataatttagaataatttagaatttgcttggggagactttggataaacagttaagaagctgtatccattaggtaaagggacattgcttgctgcgtctcgtagcatttggtagtctcgttagacagccgttcttactcctatcgtttgctgaaatttattagcaaaggaaagaatcttagttttcagctcgttcagccgcatgatttcataggctcaggaaaaccatgtaatatgcccaaggtcagacgtgatgaataagactaaagactgaatctattccagtgtctctgtgtccagtgatacttacttactgctgttgccaagttaaacaaaactgggtttgcagagctgtttattcaccttcagcatcttttcattgaaaatgcggtagatagaagaaatgtccctcttttagcatttgtacctcagtaataagatgcttcccaagctcaaagactccacacccttaaatatgtaagtcagtgttaagatatttaaagagaacatgaatatcagctacattgtgcatgttgcaggatttttatattattttgtatcttctgcttagaagtcataagccagcccatgaaccatgccaacaaacataccttcttccatgtgattattgcagccagatttttcagtgcaggacaagcaaagttttctctgaaagcatgagataataattctcagccaggtcttcgccatttgcaagggatcagacataagagtttttagctctgttgatgttaatagctagagcccctgttagcagatggcatgttagtggcctgttgctgctggctattaaatcatacacattggccaggcacggtcggtcacaccagtaatcccagcactttgggaggctgaggcgcacagatcacaaggtcaggagtttgagagcagcctgaccaacatggtgaaaccccatctctactaaaaataaaaaactaggcaggcatggcggcacatgcctataatcccagctactcaggaggctgaagcaggagaatcacttgagcccgggaggcgaaggttgcagtgagccgagatcacgccactgcactccagcctgggcgacagagcgagactccgtctcaaaaataaataaataaaaatattaaaagtaaatgatacacatcatgagatcatctcccaaggcagcagagaattttgcgtatttttttcttagtttatattgttgcaacagagtaattcttcttgatcacagactttgctttttttgttgttattgtttctaagtttcacttgatcctcaaaataacctgagacagacaaaacagataggttttcccattaatctccttcatgagtctgactttgccagccaggctgatcttatatccatagccctggatgcatttatttatgttattccatctgcctataatgcccatccccaatcttggcctattacatgtgtctaacattactttgatgtgtacatgtcagtgaattaccacttaactgattgttagctttttgagagtatgtatcaaatctcatgtgcatttgtgtgtcctgaaacaaattattaggtataaagtatgtattgcaaataccatgcccagggaatatttcagagctgtggttctccaagtgtggtccttagtctagcaacatcagcatcgcctggcatcacctgggaacttgttggaaaagcacattccatgatcccacccctgacctcctgaatcagcaaagctagggatggggctgagcaatctgtattttatcaagctgtccaggtgacattgataaatgctaaactttgcgaattactgatttagagactaatcaactcattaaaaagttaataaataggtgagaatccattgtagcaccccagtcacctatgctattatcttctaaattcacattatacaaattgtatgccacaaaaatgtttaaggtgaaaacccaaaggaattgatgcattggattaattcacaaaaatttaacagctgcaattcatagaaaaaaaatgcatgcatatctgataattagttgtagattaaaaggtgaacaacttcttattattaataccaatgaaaatgtaattttttaaaaattatggccaattggtagttttttaaaaatctgttatgccttgtcatgataaggataggtgaaaaggaactttcataaactattgctaagtatatgggtgaaaccttttagactatttgggtctacctaataaattaaaatgttcagtcttttctaattttagcaccgtatttctacagatacactggcatatctgtggagaggggcacttctgcttgtcacctgatatcccttactactactaatatttttataagcattattacctttaaaatcatgttaaagggtaaatgatgtgcaacagactcagtttccccttctctgactcctgtttagtttacatctcttttctctctctcatttgggggctcaatacccttaagattatagagaaattgcagtaggtaatgttggctggaaatgctaacttgtaagaaacttgggtggaaatggtttaagccatcagcctaaacgatcagtgaaaatgtcagacattctccgctttcttcttccaagatactatactctactgtggccttagagttcttaattcctatataattctgattaaaaaggaaggagatgctcctaatataccttgctgttgtcccctcctgttcattagggtagctgatgtcagtcaaaataaagtctagaaattcttgagtactttttttttttgtaatatactgagaatgcttgaagcaaactaaccaaatttaagtgttttaaggatattaacagtaacaggagagcccctcgattttctgctaagaatcaacctgaacagtttccagactgctggttggcaatgtcagtatcatgagaaaaactgaaaaaataagaaactttagagaaaaagaggaatcagtgcaggctaggggaatgaacttggtaatccagtagtctttccctgccagcattttgattgataagctaagtgtctgctttttctcatcccttattttttggcaggaaaccagtattttgatacttgaatgccttctttctatcttaagggagaagccttcttaaacttcaagtgtgaagtagatcctttaggtataggatgaaaaattaagtgggactatttgtgaattactaaatcgcaaccattaaagaaactaatgccctaattagcctgtcttttgacagacatggcatccatatgtaagtctaatattgtatgcaaatgtgagacaggttttgctttctagatctctttgatgtgaaaggaaaagctggcttcctggcttccttcccatgttctgtatggacctgccttcatcctgctgccaacagctcctcaagggaacatgaaagtggaattaaaccctcctggttttcagattcagaatcctgggtgattaagtggcttgatcaaaatcagaaactgtgaaagtgctaaaaatggtcaaggcccaaggagttcctcatgtgtggtcaaaagcctttcagaaatcaaagtgtgtctttaaatacctggggtgcaaaaatcagatgttttttatttaaagaaaaataggtatattagagcagaactgggggccctctgtaggagcctgagtctgggtgtttactgtcgtctaaggccttgttaatgtgggcttgaggcttcggaatccacgaacaggggaagctagcgtctctcgctgactccagtcctagctcgagctttccatactgccctacgtgacttctgcacttttgtgccatcagccagtagactgagaaaagtatctggtatttgtcggtgtcttcggtttagctgctttaagtccttggatggaaaaggctgattgtcatcctgaaatcattgtctcctaatgtgtaattggggccaagtgaagcacagtaatttagaggaattctagttaaaaatacagattcttgggctctacctcagacctacagagatctgcatttttcttattcccccaggtgatcctttaaacattcagaggtttttaaaactcatgcttatatgcaataacaaaaatataaggattcttagaaacttgttatatttgtcttgaacatgggatgacagacattgtcattttcattgaaaaaaaaaatgaagcagagactcagaatgtatttagagacaactctaaatacattctggcagagcctaactactggattgcagagatcctccctgcttcccccagtccccatctataaactggccatgtgaatttctagtggtgttcacttccaaagtggtgattttataaaatattacaatgaagcattattaacctcaagaagttcagatgcatagagagtttatttgggtgtggcagcattagtggctaggttttatttatccaagataagacttcttattagctatgaaaagggattggcataaactgcttattaatgtccattaactgtatctaaagggaataaacagtataaaaggccaggcatggtggctcacacctgtaatcctagccctatgggaggctgaggcaggaggatcatttgagcccaggagtttaagaccagcctgggcaacatggggagaccctgtttctacaaaaagtcaaaaaaataataagctgggtttaggggtacacacctgtaatcccagctagtcaggaggctgtggttggaggatcacttgagcccaggagttggaggttgcagtgaggcctggcggcaccactacactccaggctgggtgacagagggacgaccttatctcaaaacaaacaaaaacaaaaaactgtataagcataagatgggcttgagtcacaaaattctgcctttcataactttcccccatttgctgtttgatttgctgtttcagaaattgtgaacctacttctctacttatagaacatttacctccctcttagattcttccctttctatcattgatactgacattctgcttaaagaattatccatttaggctctcttcaaatccaaagtgatattattttattttaataagagatgaaagggaaaattgacaaaatgtgcctggagttgtcagcattgtaaatgatggactgtaaaagcttcgtcttggaagattgtcagagagcctagtgccagctcaaaaagtgtggtctttttagagaattgacagaaatgttacaaagaaaacatgtgctgaataccaactccaggtgcgaatcctgagaagcaactcactctattctgcagtaggagatgaattttgcaggttatacagcagagcaatttaaactcccttgtttcttaaagtatatcctatagtgacttgggatggaagtcatatactatccccttttttgttccttcaaagtaaatacaccacagagctggagatgtcccagacacagggggaagctgtttggatttttcccactgcctgtaatgaagcaagatagggaggaagaacttgggaacttgcgtggcaaatggtcaagtaaagaaaaagaaaagctttttctttacttgaccatttgtcacatgtgctttcaaatcctgaactgagtcacatctgaaataaatcacttccttgtcatttccatgaaaggggcagtacaagaaattccttgcacatccctggtgagccccttgttactctcagattcagctattgccttcaggaaaaaaagaaaaagaagccgaagaaagaaagaaaacagaatcctctagaaaaagctattctgacctgtgctctttcttttgtctgagtgtgactagataaatgcattagtctgctagggctgccataacaaaataccaaaataccacagactgaatccttcaacaacagaaattatttttctcatgcttctggaggctggaagtccaagatcaaggtaccagcaggtcggtttctgaggaggcctctcttccttgatttacaaatggccacctacgcatcatgtcctcacatggtctttctcagagagaaagagaggtgtctcttcctcttcttcttttgttttgttgagacagagtttcgctcttgttgcccaggctggagtgcaatggcacgatcttggctcactgcaacctccacctcctgggttcaagcgattctcgtgcctcagcctcccgagtagctgagattacaggcatgcctggctaattttgtatttttagtagagacagggtttctccatgttggtcaggctggtctcgaactctcgacctcaggtgatccacctgccttgccctcccaaagttctgggattacaggcgtgagccccgcacccggcctcctccttttcttataaggacacctgtcctattggatcagagtcacacccccatgacctcatttaaccttaattatctctttaaaggtctgatctccaaaggtcccttgagggttagggctttgatacatgaattttcaggggcacacagttcgatccatagcagttggcttattcatactttgggtagatcctcttcatcgttcctcagctactgtctatttagtgcacagcttctttatcctaaagctagtcaggggaggcatggaaggtattatttctcctgtttctgcacctaaggcattaaaacgaggttgtggtctggcagcctaaactcggccttgatgaacttcaaatcctagacctccttggtatgtgaagtgcatacacttgtatggagggatttgacaggttttttttttttttttttttttgagacagagtctcactctgttgcccaggctggaatgcagtggcacgatctcggctcactacagcctccgcctcccggtttcaaatgattctcctgcctcagcctcctgagtagctgggattataggcgcgcaccaccacacccagctaatttttgtatttttagtagagacggggtttcagtatgttgatcgggctggtctcgaattcctgaccttgtaatccactcgcctcggcctcgcaaagtgttgggattacaggtgtgagccaccgcgcccagcccagatttttttaaattagtttttagtgtatccacactgttaaagcaggtggatactgctggatagtataacaaagtatagtgtgacaaacccataaccaagcattgttagctatattttctcatgtcttgagccaaaaggtcacagttaacctaatgttgctactaaacactcataccataaaacattctattccagtcttccagattttacacaagaataaaatgaaaacttttagactactggagatttttttttaaatacacaatttgttgaatgtgaacgctaaattgaaattgacatgctaagttttatagattacttcagctgccctgacttcagtaaatttagttgtgacacaggtacaacagctgacttctttctggcattagaggtggtgatgtttcgtcactctggagttagtaaaacctgaaacccgccaggcatttgacacacagtttgctgccagggacagctcagcttctggcttattggagaggaaatgacctaacctctgtgtttacaaagtgtttgaaactgaggcccttccacttccttgctgagtgtaagggttgacctggcatccaaaatccccatgatcttctcaggataagtcatgcagccattggtggtcaagaaaggatttgttccctgtggaagggcattggaagaggaacagagctgaaacacacgggtgttcagagggaaaacatctctgcacttaagagggctagattagactattagactattatcatagagctcgtgattcatctcctttgtttaattccagccttgagtaaaggactcactaagaaaccacattcggccgggtgttgtggctcacgcctgtaatcccaacactttgggagaccgaggcagatggatcacaaggtcaggagttcaagaccagcctggccaatatggtgaaaccccgtctcaactaaaaatacaaaaattagtcggggatggttgcgggcgcctgtagtctcagctactcgggaggctgaggcaggagaattgcttgaacctgggaggaagaggttacagtgagccgagatcacgctactgcattccagcctggtgactggagcgagactccatctcaaaaaaaaagaaaccacattctattccagtatatttattataaccagaaattcttgtcttatcagcaaatagctaatattcacttacatgggcagtgtattagattcctagggctgctggaaccagttaccacaaaccgcatggccgaaaccaacagaaatatactctcattatctcattattctagaggttagaagtcctaaagcaaggtgttgccagggccacactgcctcttacagctctaggggagaatctgtttcatgcctttcgcttgctctagtgctgctgccagcccttgatattcctttggttggtacatgcacccctccaatctccacctctgtcttcacatggtgttactccccatgtctctgtttctgtgtcttctctaatatgattaagggcccacccttctccattgtgacctcatcttatatctgcaaagaccctgtttccaagtaaggctgtattcttaggtgtaggcattaggacttcaacatatattttgggggaaaattcaacccataatgcggttatgtttttattttccttgacttttaagaatgtgaactattgtcaaattttttcaaccactatcaaatttaaatctaagaactacatgtcttaaatttatgacctcttcattaaaaaaaaaataataacatttaattggtaccaaaacgtgaaagagtttaatgctttgcatttgcttgaggctgattaatgagtaaatgtgtcaactgtggctgttttaattagccagggttaattaatgtttaccacacttggaagatgaaaaggcatgtataaatgctctataatgtgaatcattttttaatttgttgttgaagcttatagtgtagccaagtaaggattgcttacatcatacttacaaagggaggttcattaatggatacaaatacacagtttgatagaagaagcaagacctagtatttaattatcagcaaggtgactaatttacagtaatctactgtatatttaaaaatagctaggagaacctaatttgaaagtttctagcgtaaagaagacaggctgggcacgatggcttacacctatagtcccagcacttgggaaggccgaggtgggaaaatcacttgaccccagcaattcaagactagccagggcatcatagtgagaccccatctctacaaaacaaatatttaaaaattagccaggtgtgatggtgcatgcctgtagacccagctgctctggaggctgaggtgagaagatcacttgagcccagcagttcaaggttcaagtgagctatgatcacatcactgcactccagcctgagtgacagagagagacccttcctcaaagcaaaaagaaaagaaaaacatttaagtgatggatatcccattatactgatttgatctttccaaattatatgaatatattaagttttctcatataatctgaaaatatgcacatctattatgtatcaataaaaaataaaattttaaaaatgtaaaaaacgatgttggagcactatggtacttaacgtagaggctctgacttttgaggtacattcattacctgttactgaagttgagtatgctttaatattgtatgtttagaaaaggtagttacatttttaaatctgattgtgtaagaagaaaagagtagaaatgtttggggccaagtcaataattatttagtatatcataatttgagatgaaatgtgtttttttttttcttttttagtttcaagttgaaacattttaagaacagataaggaaaggctaactgtgctgagatgaaaataacatttttaaagtaactatcttaaagaaaatacatttctagaattttgtgtaaattttcaacaaagactcagaagcctggatgaggtcttgtgccaagactggaaagtgtggggattagaaaaagtttgaagagattgttgtgagatcctctcgtatgaggcctgaagctgtacatccatggaaagcagttaccccaggcgggaaaacaggttatccattctcgagtgagtggccgggtgggaaatagtccatcatgtcgaatggatcgtactttccagcaccaagatttgtggttctctaggtgaataagatgacaccccttcacttcacttcacttcaccattgtctgcatggagtacgtatctaaaaacaaattagcaaaaaggttgggtctactttacttttcatctcctacactattttcttctttgttctcggcaggaaaagatgaagttgcattttattattatctcataggattcttattctaaaatgatttgatttaaaacccattgcactttatttggataaaaaatgcttcactctctagttcttaacaataacaccagcctgattttattacgttaagcactgcaattagacaatacaaagaatttgcagcaacaacatgttattttatcatgggtggaactgttcattgtctagcagaatttattaccagataaatcccttttggggaatctaatgtggatgtttttttcaaagcgcctgtggagttctgctagtattgggaacgtttccattttcattctgatgcttccctgtgggctgtttcagcatagaagtgagctctctgggtccatgtttccattggctccacccaatattctgaaagattgcaactcaacatgtgtaaacagaacctttctcccccatattttctcttttcgtagattaaactcaggtcaagaattagaagtttatcctccaccccgatagcatctcgccctatcccaaataccgccaccaaaatgcccactgtttttccttgggccagttcctgaaatatctttctggctgtatcactcttgtgtgcatccttatcggctatgcttttggccattttttactgctgacttgtctggttagtcttttataatctccaggcttctcctccatcctttttttacagtttacctgttcatgaagcgcaggtcacttgacccgtagaattcccataggctgggattttgctaattgcatactcatggtataggtcagtgtattcctctgccctctgtatcccacaaactgaaagcctcttggctaagctgcttcccttttcacttcccttgtaccacagcagccagaagagtcacagatcctgggcagcttgtcctctgtgcctcggtacatgcacttgtatctgctaggacaatgatctctttccctggggccccactgtaatatcactagtcacatccctaaagcccaggcttgtttctttgtcattctgtcggtatccctaccataacacttgtaatagtaattatttttatgcccatcttttcttctgaaccatgagcccttcaagtgaaaagaaattgatgaagttatttctagcactcccctggaaaaaggaaggcaggcagggagggaggggctcactagtttatgataaagtggtttgattttcttggttgcagattatttcttttaaagtgactcttttcagcttctctcactcctgtgcatcgtgaatgctctcctgaagacagacgctttccattcatttccaagccccccatgtgaagtgctttctgttgccaggcttggtttccccacacgttgttaaagaagttaaagaagcttgtgaataagctaaagcagaggagaaagaaccattgctatatctagaattgttcaccagaaagcaagttttgtgttaaagaaaacacgagtaggccactgtgcagaagtgcttacagggtttgtgtgctttttaaaatctgcataaataaacatttcaaatgagctatcatatatacaaggatgatgtgctgtctgtgggaaaaggacccaatcctgtgttgtgattttacatatatatatatatataatttgtgctattacacacttgcctgatccccttataattatctgcataagtctttttaggctctttgaatgaaattcactatgtatggatgttgaaaatcatcctttctaccatgagctcatcagacttgctaaccaattctttgcatcctttgaagtataaaattccatcaattcagcatgtatcaacatgaatcaattagaatgcactttcttcacagcatggcggagtttttgctggctgccgggaggggcactgtttcccaattcattcatttgcttgggcccgccccaggatccttcttatcccggtcagatagacttctctcatgagcttgagagacggggctggtcacacaggacacggctttagggacacgactcactgaaactacaaaatgagtgctgctcttagagttgtacccacagcctgcacagctgttatggcaatgctgtgggcaagtcttgctacggcccattctcctccctcccttgtcctgttggaaggttcaggttggagctgaaattcagtccagcacgcagctggacaagccatgtctcctgtatgtgactcactccccagagaaagcatcatgtggactagtaagggcttggctttatcagaagcaaaggagaggtttacatctcttcttgctctctcttagtgggttcagagctccagcagaaaaaatgggacactgtggattgatctccagaaaaccccaaaaccagcactgaaggctccaggagattatgcctttagattgtatacaggcaccagaatgacttttgcctttataaaaatgcgtgcaagagcatgaaaactaatatttgaggaatttttttttctcactgtactttctggtcctcactgaaagcattggcagttttaaaaaatgaaatgtgatactgttatagacgtagcaaacctcacgtttcattttttccaattcattctatatctaggaacttacttagaaggagaaacaaactgtacccagaaaaaggaatgaaactggagaattcttcctcatgattcctctgtgtcctcaggcctaattatcctcattccaaagactctccattgcctcaataacttcgaaaaatttactctccttaagcatagtcataaaaattgcatagtaaagtgataaagagacgaaaataatgctgtaagaataaaaccattaaaaaaaaaccactactcttgattatttctgctgttagaattgtaaatgaattctcattccttttttctacatttttggcatgaaatttatgttactcttataattagtaaaaacattatattttattaataaaagaagactcacagtgaagtcataacatatgctgcagaggttagactcttcaagtcagatttgaagagagaatttcacgtaacaatcaccttgaaatgtcttcaggtcagccatcaaagtacacatctctcaaccagccaggcagccagtttttcctccagcatgtgaagagtgaagagatagctgtttcttggcttaaagaccatatgaaataattgacttatgtttaaaagatatgagggatcaggccgggtgcagtggctcatgcctgtaatcccagcactttgggaggccgaggcgggtggatcacaaggttagaagatcgagaccatcccggccaacatggtgaaaccctgtctctactaaaaatacaaaaactagccgggcgtagtgatgcgcgcctgtaatcccagctactcaggaggccgaggttgccatgagccgagattacgcctctgcagtccaacctggtgacagagcaagactctgtctccagttaaaaaaaaaaaaaaggcatcaaaattacattcacttctatttttatttttgtttgtagaagacatgcagtttgtatcacattaatgggcatatgatgtaatttcactataaatcgaaccagaggaagacatccaaatatgtataaattaaagctgacaatgcctacagtactaaactttttgttttagtataattggagacttagaaaagttctaaaaatatatttaaaaatttttaaaggaagttgcagacataatggccctttacacctaaatacttcactgtacgtttcctcaaaacaagaagatatgtgtgtgtgtgtttgtgtgtgtgtgttgtaatcttaatacagcatctttcagagattatttctgtagtatataaacttggtttttttgtttgtttgtttgtttgtttgtttgttttgagatggagtctcgctctgtcgcccaggctggagtgcagtggcacaatcttggctcgctgcaagctccgcctcccaggttcacaccattctcctgcctcagcctcctgagtagctgggactacaggcgcctgcaccatgcccggctaatttttgtatttttagtagagacgcgatttcacctcgttagccaggatggtgtcgatctcctgacctcgtgaaccgcccacctcagcctcccaaaatgctgggattacaggcgtgagccaccgcgcctggccataaagttgttttttagtctctactttaagttcctgacaacccaggcaggaccaagactccctaatgtagttggaaatcagatcagcacattggcacaagttctacaggtaaacgggaaaaaggagccctacaatctgcttttagatgccagggagcctggctggtctttatcttgattactgactgatgccactggtaggtctaagttctttgatctatgatgtttgaaagccaaaaggaaatgtgttttaaaggaaaagggacttcttctgtaccctcagtctaagccagacaagtgatatttcaggaaaatgtccctagcaataaggaatattttcacaaatgatgtgaagctttgtttgtgtcccttccagggcagtttgttaccataaggggacaaagcatgcttcatttaaacatgtgtggccaggaaactgttatttttaaacaaaaataaaccccgatttagacatgtagtctgagttttaactctgggagattttcaagattgatagtgtagctaaaaataactgacctaattttctggaggtcaagataaaaactggatttgtggtacagcatttactttgtgataatatgtgtataaattcttccccaagttggaaaatgtggccgcgtcatacagggctgtatctctcttgaccattgaagtgcctaggtcgctacactacaatttgacttagagttggtgaaacttctggccattcacgtagccatcgtattcatcctgagaaagggaaacctaaagacttgggagagtgttctgggaggaaagtgctattgagaatgggctgtccaagcaaagtgacaggcaggcctcacttagctagaagagggagcttttcagccctgctccaccatcaggaatctccgtgaccttggactactgctttaatctcttttatcctggcttctaaaagataccgtcgaattcattctttttcaaacctatcaaaaatttgaaatgtatgaaaaagagggtgcttgtgatgatagatgggtttatgcttccttttttttttttttttttttttttttgagacggagtctcactctgttgcccagactggagtgcagtggcgcgatctcggctcactgcaagctccgcctccggggttcacaccattctcctgcctcagcctcccgagtagctgggactacagtgccaccaccacatctggctaattttttttgtattttcagtaaagatggggtttcaccatgttagccaggatgctctcgatctcctgacctcatgattccaaagtgctgggattacaggcgtgatatgcttctttaatattagtttctaatccaagtaatatagccatgtcctctataaaatggaacttttcatggaacagtgagaaggttgcattaggaattgggatacttgggttcagatttcagttctgccacttgctagttttaagtatacttctcaggatggatgtcagtttgttcaactgtcagtgggagtagtgatcccactaaggaagattattgtggttatcaaatcagcagatgggtatgaaaaggccatgagtgcagttctcatggttatgaaggtgtcataactggcatagtcccatcacagtatggctttggcatcgcagatggctgtagcatatatgctaatcagaacatccctaccgtccttaaagatctcatgggttctctcccaaatcagctgctccaccgacctacaagtaagtccatgcttctttagtatatttactcactagtgaaggcccgtctgctaaaagtgtcttcagtaggggagagctgctcttttctgggaaacccagcaatgaagtttgtcctgtgatgccctctacacttactgacctgtttcctgagaacttcccgtaacaaatggtccagggaagaaggaagtctgtgaccagtctttcctttcctgtggctttctggttcagaaatgtgaccctgatgataagaaacttcaaggcatgactctggtgttttggcaatattcccctggcagtattgtttcttggctcacactcatctcatgccttgctttgtttgctttgtttttgagaattgtttttttgtttgttgtttgtttttggttttggcttgtgagacagagccttgctctgttgcccaggatggcgtgcagttggcacaatctcggctcactgcagcctccacctcccgggttcaagcaattctcctgcctcagcctcctgaataatggggattacaggcacacaccaccgtgcctggctaatttttgtatttttttagtagagacgggtttcaccatgttggccaggctggtcttgaactcctgacctcaagtgaaccacccacctcggcctcccaaagtgctggggttacaggcgtgagccaccacgcccagccattatgtttgtttttctttcatgaagggataaccgaggctgttgtgtggtggtgtcttggtacagctcgtggctgtggtcagtgtggtggagggtaggtcttctcagatggtaacatgcatgagagtcacctggggatcacattaacatgcagattctgattccctggatctgggtgggacctgaggttctgcatgtctaacaaactcccagagaacacccatgtagcaagagtacagacaaaaggattcaaagcgaagggactgcaagaaccatggaaccagcctcccacgattttgcggatgacgaacccgagccttggggagtttcagaggccatggagagatgaagtataataaacagcatagcagttgtatgttgagccaagaatcagacatgcacagaactgctgattggaaaattaaatctgtttctcatagccctggtgtggcaaaatgcctagctggaagtgggtgaccgcttgatttacagtgggcctcctgggtagggaaaattagtccatcccatttacagctacttccaatgcagctgtgtcaggggagagagaagaaaggacatggaagagagcgtagaggtatgatcttcagtcctttcaggcaggcacataagtaaatttttatttaaaagataagaattggtcatatgcgaatctcctgttagataagattaaaaacaaatttccattttgtggagaagttgcagataaatatttttccatgggatccaaaagaatcaaaaaggaaagaaaatagtaatagcagtggaggttcgatcctagacagaagaaaatccagcaagccgagggacttcatattctcactggtgtccaaatcagagctttttttttttttctttgtttactttaagttctgggatacatgtgctgagcatgcaggtttgttacataggtatacatgtgccttggtggtttgctgcacccatcaacccgtcatctaggttttaactccgcatgcattaggtatttgtcctaatgctctccctcccctttcaccccacccctggacaggccctggtgtatgatgtccccctccctgtgtccatgtgttctcattgttcagctcccacttatgagtgagaacatgagtgtttgggtttctggtcctatgttagtttgctgaggatgatggcctccagcttcatccatggccctgcaaaggacatgaactcaacctttttttttttccttttttttttttttttgtatttgcaaattcaaatctttttttttttttattatactttaagttttagggtacatgtgacattgtgcagcttagttacatatgtatacatgtgccatgctggcgctgcacccactaactcgtcatctagcattaggtatatctcccaatgctatccctcccccctccccccaccccaccacagtccccagagtgtgatattccccttcctgtgtccatgtgatctccattgttcaattcccacctatgagtgagaatatgcggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaattgcgacactgacttccacaatggttgaactagtttacagtcccaccaacagtgtaaaagtgttcctatttctccacatcctctccagcacctgttgtttcctgactttttaatgatcgccattctaactggtgtgagatgatatctcatagtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtccattttggcttttgttgccattgcttttggtgttttggacgtgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgtttcggttactgtagccttgtagtatagtttgaagtcaggtagtgtgatgcctccagcttcgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagttggtttgtagttctcctttaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcgtatcagcttaaggagattttgggctgagacaatggggttttctagataaacaatcatgtcgtctgcaaacagggacaatttgacttcctcttttcctaattgaataccttttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacctttattgatttgcgtatattgaaccaagccttgcatcccagggatgaagcccacttgatcatggtggataagctttttgatgtgctgctggattcggtttgccagtattttattgaggatttttgcatcaatgttcatcaaggatattggtctaaaattctctttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaaccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgtgtagaggtttttgtagtattctctgatggtagtttgtatttctgtgggatcggtggtgatatcccctttatcattttttatcgtgtctatttgattctcctctttttctttattagtcttgctagcggtctatcaattttgttgatcctttcaaaaaaccagctcctggattcattgatttttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattattaatcctgagttctagtttgattgcactgtggtcggagagatagtttgttataatttctgttcttttacatttgctgaggagagttttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatgtttaggatagttagctcctcttgttgaattgatccctttaccattatgtaatggccttctttgtctcttttgatctttgttggtttaacgtctgttttatcagagactaggattgcaacccctgcctttttttgttttccatttgcttggtagatcttcctccatccttttattttgagcctgtgtgtgtctctgcacatgagatgggtttcctgaatacagcacactgatgggtcttgactctttatccaacttgccagtctgtgtcttttaattgcagaatttagtccatttacatttaaagttaatactgttatgtgtgaatttgatcctgtcattatgatgttagctggtgattttgctcattagttgatgcagtttcttcctagtcttgatggtctttacattttggcatgattttgcagcggctggtaccggttgttcctttgcatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattacgtgtcttggagttgctcttctcgaggagtatctttgtggcgttctctgtatttcctgaatctgaacgttggcctgccttgctagattggggaagttctcctggataatatcctgcagagtgttttccaacttggttccattctccgcatcactttcaggtacaccaatcagacgtagatttggtcttttcacatagtcccatatttcttggaggctttgctcatttctttttattcgtttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttctttggaggaggagaggcactctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgcagtgtgaggtgtcagtgtgcccctgctgggggtgcctcccagttaggctgctcgggggtcaggggtcagggaccacttgaggaggcagtctgccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaagcaggcctccttgagctgtggtgggctccacccagttcgagcttcccggctgctttgtttacctaagcaagcctgggcaatggcgggctcccctcccccagcctcgctgccgccttgcagtttgatctcagactgctgtgctagcaatcagcgcgattccgtgggcgtaggaccctccgagccaggtgtgggatatagtctcgtggtgcgccgtttcttaagccggtctgaaaagcgcaatattcgggtgggagtgacccgattttccaggtgcgtctgtcacccctttctttgactcagaaagggaactccctgaccccttgcgcttcccaggtgaggcaatgcctcgccctgcttcggctcgcgcacggtgcacgcacccactggcctgcgcccactgtctggcactccctagtgagatgaacccggtatctcagatggaaatgcggaaatcacccgtcttctgcgtcgctcacgctgggagctgtagaccggagctgttcctattcggccatcttggctcccacctcccgaactcatccttttttatggctgcatagtattccatggtgtatatgtgccacattttctttatccagtctatcgttgatggacattttggttggttccaagtctttgctattgtaaatagtgctacagtaaacatatgtgtgcatgtgtctttacagtagaatgatttataatcctttgggtatattcccagtaatgggattgctgggtcaaatggtatttctagttctatatccttgcagaatctcctcactgtcttccacaacggttgaactaacactctcaccaacagtgtaaaagcgtgcctatttctccgcatcctcgccagcatctgttgttgccagactttttaatgatcaccatcccaactggtgtgagatggtatctcattgtggttttgatttgcatttctctaatgaccagtgatgatgagctttttttttttttttcatatgtttgttggccacatacatgtcttgttttgagaagtgtctgttcatatcctttgcccactttttgatggggttgtttttcttttttttctggtaaatttgtttaagttccttgtagattctggatattagacctttgtcagatggatagattcagatcagagctttaacagccagactttacagggaaaaggctgagtggcacctcctttatatgaagaaaatgttcttctccaacccacttgtgttcagtggatggaagaagctgttcagtaattataactgacacttgtaacacataactgattgatttaatgcccataaattttattttctttaatcgtaagatgtgaccgttaaattcttagaagacatttggctagtggattaataattaaaagaatattggatgaattcatctgcttcctattcagcagttcttttatttataaggctatttttctcaaaatgaatgatcatgaatatctaagaaaaaacaaaatatttagctgtttgaagatgaaattattatcttttgatgttgttttctttaaagtgtttacaatgataactaagtggtagggcttcttccctctgttactctaagtatgcctcgtatacatcctcaaagcattttttttttttttttttttggagacagagtcttactcggttgcctaggctggagtgcagtggcatgatctcagctcactgcaacctctgtctcccaggtttaagcaattctcccgccttagcctcccaagtaggtgggattacaggcgtccgccaccatgcacggctaatttttgtatttttagtagagacggggtttcaccaagttagccaggctgctcttgaactcctgacctcgtgatccacccacctcggcctcccaaagtgctagattacagacgtgagccaccacgcctggccacctcgaagcatttgtaaaagagcaaggtgatggggttcattaggtgtttggtatttgaaattaaatacctctgttattgatgaagccatattttaaatattatcaccactaaactcagttaaatatttccactgttaactacaaggttcaaatgcttggatattatagaagatatttgacttcaaagataaacgctacaattttgggtcataacaaatagcttttagaaggggaaaaaataagtcttgggaggaaaataagcagtctcttagtttaatatagcggttggcaaatatagatgcttaaaagttctgaaaatccccattgcaggccatcagagtgttgtaattaagtattaaattaattcagataaaaggataatccatcagggccactaatgtagtggaagtgtggtttcggtgtgattagtctcaccatggaagtcaaagaaagtcccactcagaatgaacaatgaaagaatcatatttgtctctgggtattttgtcataggctcaattgcccagtgccagtgtgtaagccactggtaaaatcctgagcccttagtcatgtctacaggtagctggctgccttagacattttatgatgacgaaattgaattccacttctgataatggtaatccatcatgtctacctctttttttctcttaaaactacactgacggccaggcgcagtggctcccgcctcatcccagcactttgggaggccaaggcaggcagatcgcctgaggtcaggagtttgagaccagcctggccaacatggagaaactctgtctctactaaaaacataaaaactatccggtcatggtagtgtgtgcctgtaatcacagtactcgggactgaggcaggagaatcgcttgaacccaggaggcagaggttcgttgttctgaatgacatagccaggggtggttatttctaaattttctgtgttgaattaagataggaatgtggatttcttcctattttgaacaacgaccaaaaaaaaaaaacgaaggctaagtgtgtttcactctgctaaaaatgtaccttttcttgaatctgtcactttttcacttacattttctgaaaatgaatataattaaccaccatggggctcagcatgctggtggccatttggaggaacttttctaccaacagtgtaacagagaaaagagaaaagggtactacagcgtacctcaacctcccctgactgttctgtgaagtacaagtgtaagatttctcactgtgatcttttgctcctctgcctttttactgccaagggctaagatgggcacagggccctttccagctgcccctgcctgagaaatgcttatttgatgaccaaaagcaataaccattccataggactaacggtgattaagtcagcttacaaatccacaagggtggaagagactgctaaagatattggaacagacatgcttaataatgcctaatttctacagctacttttgtgataatacgagaggctgaaatagataggggctgaacatgggaaggctggtgttatgaagcccaggacttggatttcagcactggtgcttactggccattgggtcttgaagagattggttcctttctcccagcctcagtctccttgtcccatcagattaataatgcctgccttgggagaggagagtcatacaggagagggcatttgagctgggctctaaagagttcaaataacgtagatgagcagagatgggcttccaagatagcaggaatagaaaacaaaagtgtcagaatgggtatgcatggtcttttgtgggaataccccaagctatttagcctgagagagaggtgtggtgtagacagctggagctgtgagttccatggctagaaatacggggtgggcccagaccacagagggccttcagcatctggcaaaggagttggaattaattcggtagaaaatgaagacccactgaaacaaagagggagccattcttgtgtgtcaggaactaagatttcaggaaccaaacgtaaaataaaaaccagcagggagaccattgtctcagtcggtttgtgctgttatcatgataccagagactgggtaatttataaacaaacaatagaaatactacaattctggaggctgagaagcccaggatcaagccgggtgcagtggctcacgcctgtaatcccagcactttgggaagccgaggcgggcggatcacgaagtcaggagatggagaccatcctggctaacacggtgaaaccccgtctctactaaaactacaaaaaattagccgggcgtggtggcgggcgcctgtagtcccagctactcgggaggctgaggcaggagaatggcgtcaacccgggaggcggagcttgcagtgagccgagattgcgccactgcactccagcctgggcgacagagcaagactccgtctcaaaaaaaaaaaaaaaaaaaaaaggcgccttgtggctgcatcctccagaggcagcaaaaactgttctcacatggcagatgcacataaaggggcctgtgctggtttcctctagcccttttagaaggcagtagtccattcgggggcacggggtggaactgtcatgacttgatttccagaagaccccatctctcactactaccacagtggagatttaagtttcaacacatgactttgggggacattcagaccatagcaagcagtgaggagactatcgtaattatccaggcgaaaagtaatcatattcctaggggcggtgagggtggtgtggaaaagcaagcaggaaatggctgagagaattcagaaatagaatgcaaaaggatttgtcggtagtgtgagtactggacacgaagaaatacagggagtcctggatggctctgaaggattcaagcctgtgactgggagggagaatggttctgccatgattagaaaacaggaaaggtggaagggaaagccagggaccttgagtacagttgtgtacctaccaagtgcatggatcaggagggagccctaagttggtatctccagcaaactgttggaaatatacaaatttgagtgggagggagaagtcaaagctggggaagtacatttcagattcacccaaaggtaggagatctttagagtttcaagagtcgatgggatttccaaaggggagaattgtagaaagagatggaaagagatacaagaagaaaatgacagggatgaagagaggagaaaaaaagagtaaaaagagttattcagagatgtcacagggaagaagataagtactgtgtatgcgaaacagtgagaacatttccaaataaaggacatggtaagtgatagtagataccacagacccaagaacagcgtagcccctggggagttcaagagctttctcgctggcaaaggttatttcctgtcaagatgaatgtgtatgcaccaataattattagtattccagaatatcctctctttagcatagtaagtgcttaacagtcacaagcaaaagatttatataaaagaaatgctcatttaatttatttaatcagacattggctaagttattagccgctacctatggctttgtaaaacatgaaaaagttggaggaaatctaatgagggtcttttatctgtaagggaaaggtcatcatgggcatcaagtattgaattttagaaacggtgccacagtgaatagggatatattataactcagattagacttcaaaaggactaatttgcttgggacttccatcatttaaaatcacttgcaataaaactgactacatgaaaagatattaatcacaagctttaatgctattccatcaaattattttaatgggtatatttgaacagaattttaatttttcagatacattttttgtcaatagaaaagagaatttgaaagatgattgtaaaatgttacaaatcaaatttaaatcctgatcttattttcattttctctagcaataaaactaaccagtgatgtgtctgaaatatatactacagcaaactcttgacacagctatgattggaaaatgagacattttggttaatcaaatattattgttaatagtgcagtgctgtctgtcggtctctaatttgtaaaaatcagagaaaaacatggtgaatctttggtgacataagagaagactcacaaatcttcatatcctggggtcagtttttaaagcagtaattacacatgatacaagattatattctaagctctctttttccagtaagaaaagataagtcaatgatgttccataaagctgattcttgtttaatcaatttttaaagtgggggggtaggcggcactgacagcattctttggaaagggaagcaacagaggagaaaggcaggatatttggtgtctgctcacattgggaaatacggggagccaggggtggttaagtccagagaaggctggatgtctgtctgcagggctacatctggaagggcaagggaacagtttccttgttgcctcagagcataggtcatgcagcacaagaggagcatttaggaaatgcagattttttttcaaggcaagacagtgaaaactattcaagaaggtagcaaactactggccctttaatgcttttcttatccttgcaagtgtgcaaggcaagacaggagattgtctgttgtctttcagcttgaatgagattgtgcctcacttactgccgccacaccaaagcctggcgtttattcctgtgcgatcattgtatactagggacgtctaactgtgtcaggaggaaatggcagctgagcccctgtggcctttcacctctagcagtgccacgctgcagcacattggccggctgccatgctcctgcctgcagtcctgccagcagctcttgtgagctgcgactttgcataagtagcttgaatgccatgtgcctcagttttcacatctgtaaaagggagatgataatggtacctatgtcatggctctaaacgcgatcatgcacgtgaaagcagttgaagtcttgcctggcagaagtaaatggtggctgctgctgctgctgctgttgtgattgttgttactcaccaaagagatggttttgtttggtttagatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaaggtaagagtcccctgagccagcaagggcgttctgggaggtatatatacacatacataacgtgtgtgcaagagagagagttatcttttgtatgttcttgagtggtgaattttttttgatgtagtcataaatattttcattataattttactttaaaaagtaaatactaggagttactatgtcattaaaataatatatctgtgtaaattattctttatattttttatgctgcaaagcatgtaaactgccaattgttggaaaagacaacaactccattgtataggtggcaaaacaaaatggtaatgatttacataacatttgcaggtaaagggcctcttgtttcgcacatgtccaggtttgcattctagggaatattatccttcgagtgaacactcccggacgaaggggagccacagtgtattattgaagaggcagttcttcacaaggaaaatgtgtggcaataacattcttctaatttttattttccagttcctcttcttaatataaaatggtacattatataacaaaagtggatacataaagagcatgtactgtatatcatattattatgtttatgactttttcaaatgaggaaatggaggcaccaggagactaagttcttaagtgatgacttttggtaggaattttttagaaatgttttttaactgtgaggtatattgttccctctggaatggaagcacaaaattcaacttgtgtttatgacgtaatgacctagaatgccaccttccaaaaaagcagatagatagtgaaataaggaaaaattacagtttaccaacagagaggagttttgagggcctgcagagatgcagatttgacaggcaccaaagtagtcttcactggctacttattcttacatgaaatttcagattgaattaaatgttaaaggcaaagatagagaactacatataaataaaatttaattttgcttaagacttaatttgtgtttagaaaattaaatttaaggcagctgccaaaattaaggagcacattgctctaaatgttttttcctttggtacctcagagaagtaagattcttctctatcaacaaatttgagcagtagatggcatcctttttcacagggatttcttagcagaaacacctgttcaggcaagaatatctttcagcttcttttatctttttctacatgttcagaagtatacaattacacacaaacaccttgatttctagatacaaataacatgttttttaagaacacaacagcactttacctgattttctttatcaaagcagcaaatgttgatggagatttcatatttataatataccttataggccaggcatcgtgggtcacgcctgtaatcgcaggacttagggaggctgaggtgggcagatcgcaaggtcaggagatcgagaccatcctggctaacatggtgaaaccccgtctgtactaaaaatacaaaaaaaagttagccgggcgtggtggcgggcacctgtagtcccagctactcgggaggctgaggcaggagaatggcatgaacccgggaggcggacgtggccagtgagctgagatcacaccactgcactccagcctgggtgacagagcgagactttaaatttaaaaaaaataaataaataaagtaaaaaatatatataccttataacatgcaattagtactaaatctaaatataatattagaccttaagtgtactggacaagttttttctaaagaaccattgcagaaaatatatagactattttcacaatgtgaatcatcaccccaaatttgtttccttaatttgaaaaagggcaccttacagtaatagcaaacagcatgttactgacaatgtaaaaataattaaaactttaccatttatgaaaataattcttaatcacatagaagaaaacaattttagggacagttcattatcaaagacctggaaaactgtcctgttaaatgtattgagtgcagattgttttgtttctttacaggtagatagattttggtcattgaaggtcctcttcattcagtctctaatgagaatttttagtgaaaaatgtccgatctcattttgtaaattgaatgcacgctaaatttgctcttttactaacagcataccttgttgcatcagccttaggagaaaatctgcgtgcacacgtgtgaatgtacacacacacacatacactgtgaacccttggtaattgccaggatgtccatttgagcaaagcccttgattaagtacttctggatacttgacaaacacgcagctattacattgcctaggtctcatgaaaagagctgatattcttgttggatgattctgtttgaacagtagaatctggtataacaattttgggaggcaatagaacttgcagtgtcagagtcttgagttgcagtactcttcattatcagtcccaacattgacatatatatattgattatagcaaacaatttaaaaagccacttaagcaatttttttttttttttttttttttgagacggagtctcgctctgtcgcccaggctggctggagtgcagtggcgcgatctcagctcactgcaaactctgcctcccaggttcatgccattttcttgcttcagcctcccgagtagctgggactataggtacccgccaccacgcccggctaattttttgtatttttactagagatagggtttcaccgtgttagccaggatggtctcgatctcctgacctcgtgatccgcccgcctcagcctcccaaagtgctgggattacaggcatgagccacggcgcccggccccaattggtttttaaataaaatagacggccatcatctcataggatattaaatactaccccatacccctgaactcctgaatgatacagacccgagtttaaattccagccctgctatgtgcttctgagcaagttacttagcctctctggctgcttcctcgtctgtaaaataaggttgacaataattcctaactcagaggtatagtatgagcattaaataagaaggcataaaaaagctcttagcaaaattcctggaacgtagtaaatgtcagtggtagctttttttttttttaatggagccaggatcttattagagagactttatcagcctgtctcaagatgaatcaccttatggcctcaacaatgtatccttaaaataatgaatataataagccatataatgagatacagtcctaaagccgtctctcttctaacaccgtctcccacctctccccagaaacttgttagtctttctttgtacagacatgtgcacacacacacacatacacccaactactgaaaatatctaaaattctcaaaggatttccttttgttcttcatgcagtcctcattatcatagtttcaaatgcttaccaaaaatttgttgtttttcttaagaacaatcagtgaaatccagaggaggttctgatgcccattttttaaatttacattgaagaaaataagcatatcagagttttccaatgtgctgtgatttgccttaacaattttttattctttggttttcacatccacaaaacctaaatgaatggctaggctgaaatgaagctgttgttacagaattgtgctcacagatcgtgaaatgatctggctggaagcattagcgttgatgacatttgtgtttgttctactttttcctgactgcctgagaagggcagccacaaagagcagcatagcatgcagtgactgccagcaagtctttgtggccaacagtctgcctctttgtagataatacctagatataatatgtagataaaataatatttttaaagagacaaagcaggtcttataagacttgtatggatgtatttgcaaaatgtgaagctgccttctagtatatttttaactagctttatagaggcaatgaggaagccaatttaaatgttgaaatttagattaaataaatatttcattaaacttacaaaccagttcttgtcagcctcttatctatatgtaaaactggtgtactgctgattcctcattacctttggcctggtagagagtttgtacaaggcagcacggttaatagttgaggtttattacaaagaataccagaagtaacagactcaaaaatcccagaggtctgaccattctgtttctctcctcttacagcaaaggatttgattcaaagctactgagagcaagagaataactcatttctgcttacattttattttaactctattaaaagttaaagctaagataatgtatttcttgtttttaaattactaaacagccaatgtaagatgttttttagcacttcattgatgaagttactgtctggttaagtaaaggtcaattggaaaaattggaaagtatttgcagtggattgggaaataacacactactttgttttgttggtgtgtattcttttttttcggcaatgatatcataattgccttttaaaaaacttttaatgtctgctccctgagctacttattttttgagcattaatttatactaaatcagcttcaatcttttaaagcagattagggtttatgtcactgaaactagttttgtttaatcttcctaaaaaatagggttagggttttattattgtttttaaataatacatgcctatttaaaaaaatagaagaagaagaagaagagcggggagaggcagagaaacttataggacaatatcatttgtaagtttctttcacataagtatacgcatttgaaccctggaaaaaccatttactttgtgacacaactgaagttcagaaagaatgtgattagccccagatcacagagaaagtaagtggtgacattagcagtggcccgtgggactaccagctcctcagcctgcatttaaaccacaggtacacttaacttactgccccgagttgcatatacattttctaataacgtaactattgatgtatgtgctcaccaccacttcaaggtacgcgtttgccctcgtgcatgtggtctgttgtgttcttaactgcagttgaagcactattgggtccctcatcatcaggaaattctcacaaagtacaatgacctttcaactaactgcattttacaaggagtaatacagttactcattacaggttgctgcaaataggaaaaaaaatgaagtatagaaaaaccaaacctcattgtcgaaatgtatttgggagttgcagaaggaagtgaactatgtcttcctctaatgcactagtgaaatactagagaatagtcactctcgcatcagtagttactatggaatatttaatcataggatatttaatcagtgcagttctgtagtatctggtagggtctcaaacaggctttaaaggttacttatttgttcctcaccataattagaagatgcagatgttaacatttctgtttccatatggagaaacagccacagaagtggcgcatcccaaggccacagacattgtaaatgttgggcccaggcctgggattagatgcctcaccctccttttgactccaccatgctgccagtctctacatgagaaaggaccaaatttttatttcatccaaatatcctagtgctcccggaaatattttcttatattttggagacttggcttactgccactttttttctccctcactgtttctattaacatgtggcatccaaaatcgatttggactgagaatcccacctttgaatgcctggcctgtgtgcatcagtaagctggatggttttgctgaaattgttagaagccatttcatcgagcacaccgtgtctccttcagcacctgtgctcactttgtcttacctttttccctttacacttgccaccttaccaaagcagcttccccctgcacctacctccgtggcttcatttaccctatgaccattattaatcctaaaaacttcacttttgtccccattccttgtttcttcaaacgccagcgtaaaacaaggaagtattttctgagcatcagaagtgctttggaaaggtcagatgatggtgaggaatatcatgctgtccacactgctttctttgggtcggacccagaacacataaaaagggaaaattgtgaacaatggcaaatataaaatgaaatatcctcatttcacacgtttcagctgtatgtcatctgtcaaatggaagccagcctttttgaaaaagtgagaaaaagactgcggtttccctcttctgccctcatactaaggacaaatttgattcactcactaaatggcagattatatagtaaaactttgctctcctgataaattcatatttgcacttcccctggaaatttaacagagtccttttgtagttaattaactgtaaaataagataagattgggcagttgtaaaaggaagtatctttaaggttttctgctaggctgggaatattttatttctaatcaaaagccaagaaactatctctaaactagctcagagggaaatccaccctccccacccctcttctttgatgttgctgcgtatcctggtgagggcttttattagaaaactaaggagcaggactggcacatcaatagcgataagccatttaaagtggtgcccctcctggtcctcgatgctcgggattaactcactgtggttcttttctggctgctccttttttgtaacttgtttattgcatatgcttttttccctgctcgactatgtttgggagccacgacttaccatcttgatttgtcttgtttgctttctgtgtcccttgcttcctgtgcccagttgagcctgttgatgcccgccctgctgccgaccgaggactgaccactcgaccaggtatcagaaccgcttgacttgtgcctctccgcatcttgggcctaagctcgagcagacgttgtctcctttctgcattttaagcctctctcaattgtacttactgcagagtagaatttgaagtgaccttagaaaccaaacttttaaaaattccccttgactattccttactcttcatttcccaagttccgagtgaaatgattttttttgtttctgagctttccctttgaaacctaaaagagagcccttccaaatttgggtttttttttttcttttttctttaaaacaaacaaaacaaaacaaaaacagagacgattatatacagcctgtccttaaaaacagaagcccagatagatgtagactctcaggtgatgacttggataccagtgtgaacatctctcctttcttgtttggtgtccagatgggtaattttctaactgaactgggctcaaacttcaatcagttactgaagtagacatgatttcctgaaaataccagaattggtttctttccagagcccaaaatacatcttctgttttgtgggttgtatgtacttattctcaatgagtggctaaagtaacacaacagatgtggatgcataattttgcacataagccctttttttatgtattacttaaaaatcccattaacactgaaatagacacttctttttttacagtttcacaaacattaagaagaaacacatttttattttatgaataatgtcatagcacagcagaagcatatatgtgcctggtgtctactctatgaacaacctcacccaactgatagtagccagtgctttcagtgaatcaaaaagaggaagaaagttattgaattgacaaatttgtgtattccagggagattttaatcccaaataacacatacttttccatatttattttcttctttatcctcataatgtccccaggcgatagtcaaagaacagggaattaactttctttgaagatattaatacacagaggtcaacctttgctgcctggttcagatacagtcagcagcagaccaggagacccaccctgtccctcacacttccaccacaggctcgagccatgactgcctccaagcacggtcactgatgaagactgagagtctgcctgtggcatcttcatgcctttatgctgtgattaacagtggcagcagagacagtagtgtgacacgtcttgacagctggtctcgttgatttatgaatttctgtctgtaggcttttaaggggaacttaaattatagtgagtcagagacagtttcagttcttctaatgtcctccttattgtcaatgtcatgtaagggaatctcaaggagccaggagttgacattcctgttctgctcagccaacttgtaaggcctcgggctgagggtcagttcagttctaattgcaaccacagccagctcaggttggtcatttgccttgggacttttttcatggtgcttctctttaaaagacatgctcttcatctacaagcataaaatgtaacttagaaagcgctcattcgactcattcaattttatcaaatttctacattgggccaggagagcctatatgttactattgaaacatccaggaacaggtgacactaccagtcaatgtttttttcttttttaaaaaaattgttttttgattttttttttttttttttgagatggagtctcgctgtgtcccccaggctggagtggagtggcacgatctcaactcactgcaacctctgcctcgggggttcaagcaattcttgtgccccagcctctcaagtagctgggactacagatgcgccccaccatgcccagctaatttttttgtattttcagtagagacgggatttcaccatgttggccaggctggtctcgaactactgacctcaggtgatccacccacctcggcatcccaaagtgctgggattacaggcataagcaccatgcccggcctattcttttaaaaaaaattttttttaatctaaatctaacaaaaaggacacctccaaacgctgtcaaacaaaaacagtgtgttttaaaggaagagctagagaatagttaatggtattacactggtgggagaaaaccatccaaaacctttctcataacagtaagaatatgatgtcacttggggatttcacaaagatcaatccactaaattctttctaggtttgaaagaaattaaacggtagggtccctgctctcaggagcttgaggtataatagaaggaattttgcatatttggaaacatgagatggaatttggaagacaaggaaatacaaagcaacattaagtgctaacaagaatgttctgtgatgggaggagatggagtactaacccaggggcatgttaagtagagaacttactggagatgggcttccagagaggttatgaaagatttgaggcacctggattggcaaagaagaagggaacaattctattcagaagagagggtggcctaagccaagcttcctttcatacacagcgtaggcttgggttgcccagtaagatggctaaagttgagaaagaatgctcagatatgaagtgaggaagattctagttaaggtttgtctatgaatagcagtatttactgcacatgtattaagccatgcgtgtgttctgtttttgtgcttgtagtaagtttatcaaacatttgggctaatttccccgtgttttgtagcatagctttggttcttcttcacattttagagaccacccacttgagtctaatgtgccgaattatatctttagcctttccaaacttagaaagccttcccaagattgtcatgccgttcaagtgatggcattgtttttgaataatcactgttgtcctcagaaacaagttaaaaaaaggtttttgtttttcccccacccagtgctttataatcatgactgaggaaaatggcttctccttaactctcatatctaaaaaaacagaatatggtagcttccagcatgcagtgtcaagtagggaccattgtaataacagtggtgatttgggggcatagtggccattatagctcctcctcctggcttacttccaaagaaaaaatagactctgaaggactaattatacagtttgaccagaataaaaaagaaaaacacattagcgagctcttcacatagggtagaaagctaccctttctgttacaattcatcaccacccttctgcagtccaaataaagggaaaccaggtccttgacccgagccatgcaagaggtgtcatgaaggacatacctcccttagcccccacatgaacaaaaggctctgtccactcatcatgacttacaggaagagagagctggagtcaccagggcttagggtgaaatcagcacaactcaagaaagacctctaagtaagcctgcaaaccaaggtccctgccatttatttgaaactactcatcacattttattacatgcattatcaccttattatgaatatttccctatgtgccagcttactgattttgtcttttagtaagatttgcttaatgtaaaaagtcttccctagatgactattcatgctaaacaaacatgaactattatagcaagagctcttctgccaagagcttctcaaactattgagctgtaaacatgaatttatctgtcatgctgacttgataatatgaatttttttttttggaccaccaaaagtattcacagtatcatttcaaaagtagtgtgggcttgtaaagtttttagtggagagctcttggttttgttttttttttttttttttttttaaaacaggatttgtctctgtttccaggctggagaacagtggcatgataccagctcactgcaacccccatttcctgggctaaagctatcctcccacctaagtttcccatgcagctgggattacagggatgtgccaccacacctggctcatttttgtatttttagtagagacagagttttgccatattggctaggctggtctcgaactcctgagttcaaactgtttgcccgcctcagcctcccaaaggctgggattacaggcatgagtcactgcacctggccgagagctcattctttttttttttttttttgagatggagtctcactctgtcgcccaggctggagtgcagtggcacgaatctcggctcactgcaagctctgcctcctgggttcacaccattctcctgcctaagcctctagtagctgggactacaggtgcctgccaccacgtccggctaattttttgtatttttagtagagacggggtttcaccatggtcttgatctcttgacctcgtgatcctcccgcctcggcctcccaaagtgctgggattacaggtgtgagccactgtgcccggccagagctcattctttacttttatttttcagtataaatatttggctccaaaatctaaaagggaagactcttcaaactgttcaagaaagttttcttaaaaatctcagaaatatagttctaacctattgtgttgctagatcttttatttatttatttatttttggagacagagtctcattctgtcacccaggctggagtgcagtggcacaatctcagctcactgcaacctccacctgccgggttcaagcgattcttatgcctcagccttctggagtagctgggattacaggcacccgccaccacacctggctaatttttttttttttttttttttttttttttttgtatttttagtagagacagggtttcaccatgttgaccaggctggtctcaaactcctgacctcaagtgatccacccagcttggcctcccaaagtgctgggattacaggcgtgagccaccgtgcttggcacgttgccagatcttaataacagaaaaggagtgagctctaaagaaatcactggttatataaggatctcagatttaaaagggctatagaaagattaaaatatacagccagtgagaattaagagagttttagcatcactaccctataaaaataagtgtcagaaaggttcgtttcagcagaatgagttgaaacttaaccaaaaaatacttaacaatattaaagtaagaaaataaataagaatagagaactctgtgggtctcgtagcaagaagttgggggttgagggttaggtcattgagaggaccagagttaaagaatgagaaagggaaactgtcccacttccattgtgccttttatgtctatattaaagagaatgaacttctgatgaaaggaaattaaagcccgagatagatcaacatgagaaaagaaagccctagcccattagttacctattgctacgtagcaaataacgcgagaatttagcagcttaaaacaacaagcattagtttcttacagtttttataggtcaggatttgggatgtggtttagctggatggttctggcacagtgtccgtcatgtggttgcagttaagacactgcctgagctaaagtcatctgaaggtttgattggacctggtgggtctgtttccaacgtggctcactcacgtcactgttactaagagacctcagtatcttaccatgtgaactctgtaatgctgcttgagcgtccctacaacatggcatctcgcacccctgcaccaagaggtccaggaaagagattaaggaagttttagtgccttttttggcccagtctcagaagtcatacaccatcacttctatcatgctctgttcactagagcaagtcactacatcccgaccacattcgaaggaagggaatcaagttctccctcttgaaggaaggagtatcagcaaatttgtggatatattttaaactatgacatcttgctacccaagtccaagttcttatgacccagaccaactgcaggctaagagaacttgaaggggaagtagcaccattgcctgtggtctttgtggaaagctgggaaggtagggataggaaaatgaagttctgaatagcaaaaaggagagaagatagcttcacaatctgtaagccaggtatagagtgacattgattgtgggtctcttttcaaataggttatcaagtggaagctttttgaacaattggatgaggaaatggtgctaggtcacaaccagcgtggatttcctaggttttgtcagattatccttaccttctccttgtataggctgtgctcttagactggcacatcatatgctgtggacattgtgcttttcagtgtcagcaagatgtgtcacaagtttcccagaatctcgtagacaagattgaaagagtgattaggccaagagcaggaagtgaattcccctgggagccaaaggaattgggaatgtgtagcccaagtaagacaagaaccagcaggaacatgcctctccttagggtcgtgatacctgttcaaggttttaatgtggaagggaggattaggcttgctctgtgttgaatcaggctcaaaggatggaagttacagggaagctgattctggcttcatgtaaaaaaaggacagtttgggcaggcaaatctatcaaaaaatggagggaaattgatacattcctctatgttcaaacaggaactgacaatctgcccctgggtgggaacacggtagagaagatgacttcaaaagcccttttcatcctaaaattctgatgtttgataattaaatgttatagcatggacactgacatttacattttttacttatgtttttggtttttaaatgactctgcattttgttttaagcttcaaattattatttgaataatgaaattcatcagaacaattagtgttaagaatcatatagcaatttatagaaaaggaagagttcgtaggttataaattctgttagttgctaagaagcatttttaaaattatgtactatagctctttattcagcagacgaaccaattacaatctgtgtaactagaacacttgactaaaattatataatttttacaacgcttcactgcatagatacatgaacataatttatttgtaattggaacaaagccccaaagtagcagttttgttctaccaggtaattaatgctcatttttaaagccttttattattatttctgaagtaatgagtgcacatggaaaaagacacataataggctaaacaataagcccgtaagccaagccaacatattccaggaacaaatccttgccaacctctcaaccaggatttaacttctgcttttcccccattttcaaaaattatagcatgtatttaaaggcagcagaagccttactttcaggtttcccttaccctttcatttctttttgttcaaaataggtagtaattgaagttttaaatatagggtatcatttttctttaagagtcatttatcaattttcttctaacttcaggcctagaaagaagttttgggtaggctttgtcttacagtgttattatttatgagtaaaactaattggttgtcctgcatactttaattatgatgtaatacaggttctgggttgacaaatatcaagacggaggagatctctgaagtgaagatggatgcagaattccgacatgactcaggatatgaagttcatcatcaaaaattggtacgtaaaataatttacctctttccactactgtttgtcttgccaaatgacctattaactctggttcatcctgtgctagaaatcaaattaaggaaaagataaaaatacaatgcttgcctataggattaccatgaaaacatgaagaaaataaataggctaggctgagcgcagtggctcaagcctgtaatcccagcactttgggaggccaaggcgggtggatcacgaggtcagaaattcgagaccagcctggccaatatggtgaaaccccatctctactaaaaatacaaaaaagattagctgggtgtggtggcaaacacctgtagtcccagctgctggggaggctgacgcaggagacttgcttgaacccaggaggtggaggttgcagtgagctgagatcgtgcctaggcgacagagcgagactccatcccaaaaaaaaaaaagaaaagaaagaggctgtatgtatagttctttcagactacaaggcagcaaagttcgtgcatgactcgggacttaaagtggaattaatttcaatatagcagccactttgacttccactgtgttttctgggaaaataggtttacaataggtttatttgaaggatcaaacacatgcatacactgcttggttttacagaacactttatgtggcttaaattcacatccggaactgtcttcctttacccattcatttctcccccagctctttcttttcattccctcccctacctcccatgatttaacttctcttgcaagagtaagatcatggagtgagcaggaccccatgatgttcccgatagtgttattcatcaaaaggtttgtgcaaagaagacagcagcttccttttcagatgaaatcacttttcccccctaatgttagaattggagtaaatcaaaaagccacatctcctttgtggtcagctctagtagttatataaaatcctttaccaaaagcttagaaatggagataaatcaaatcgtggattatgttagggttccatcttatcagtaggtgcagtaagagggttaaattaatgaagacgacaattttatcacattcagtggtggacagaaaaatggtaagaaaatttccatagcaataatacttaaagttatctcaggcacttcttttgttttgttttgtgtgtgtgtgtgtgtgagtgttacttttttccaagcagaaaatgtcttttcaatattcataaagttgataaatcctagtattaatctctaaaagaaacacctccaaattattatttatgccttacttgactccaaataattgtagcaaataaaaaactgacttgggatttggatttgcattcttaactcccatagttctttttttgtagaaagacatttagctttttgaagcatggttttcattggcaagataatctagtatcagttgttataagatcagggtttctcttgatgaggctgttgctgaagaggttaataaaaactggggaaccactaaagagttgaagagttggtggggtagaaagctgacgattaatgtacagatttgcatttgtcggggcctggggcctgtgtcatataagcccatccccacaattacactaacgcctataatgcgacagtgactaatggcagcggcagcaattaggagaatcagctccctctactggactagttaagataatgtattataattagtgcaatgaatattacaaaattacagtattttcttaaaggcacaggcatatgtccagacttgtatttattcctgattacctcacactagtatattagctaattaatgatttgcttttcataaaaatgttgagctagcatatttgtttagtaaagggaataattatgaacaatttctcattttgttataaaccacgagtaaaacacttttagaagttgcttcatttgctatattttatattgcctttccagattgctagtatgttagtttcagcttagaaaaatcagtcatttgactaccttgaggctaaattgaaagaattttttagggaggtacaggcataccttggaaatttcagaacaccacaataaaacaaattttgcaacaaaatgtcacacaaattttttggcttcccagtacatataaaagttatgttggccaggcacggtggctcatgcctgtaatcccagcactttgggaggccaaggcaggtggatcacaaggtcaggaggtcgagagcatcctggccaacatggtgaaatgccatctctactaaaaatacaaaaattagctgcatatggtggcatgtgcctgtagtcccagctactcgggaggctgaggcaagagaatctcttgatcccaggaggcagaggttgcagtgagccgagatcgcactccagcctgggcaacaagagcaagactctgtctcaaaaaaaaaaaaaagtttgtatttacactatactctagtctgttacatgtgcaatagcattatgtctaaaaaaaaaaaaagccatgtatatactttacttttattagtaaaatattttattactaaaaatgctaatgatcatctgagtcttcagcaagtcctaatctttttgctcgtggagaatcttgccttgatgttcactgctgcaggctaatccaggtggtggctgctgaggtttgtggtggctgtggcaatttcctaaaataagacaataatgaagtttgctgcatcgattgactcttcctttcacaaaaagatgtctctgtagcatgtgatgctgtttgatagcattttgctcacagtagaacagctttcaaaattggagtcagtcttcgcaaatctagccactgcttcatcgagtttatgtgatatcctaaatcctttgttgtcatttcaacagtgttcatagcatcttcaccaagagtagattccattgcaagaaaccactttctttgctcatccataagaggtaactcctcatccattcaagtttgatcatgagatggtagcagttcagtcatgtctttaggctccacttctaattctagttctcttgttatttccaccacatctgctgtgacatcctttactgaagtcttgaactcctcaaagtcacccatgagagttggaatcattgtcttccaaactcccgttattgctgatgttttgatctcccatggatcacagatgttcttaatggcatctggaatggtgaatcctttttagaaggtttgcagtttactttgcccagatccattagaggaatcgctatctatggcagtgaatagccctacaaaatatatttgaaatatattttgaaataataagaggctgaaataataagacttgaaagttgatccacaggctgcagaatggatgttgtgttagcaggcatgaaaacaacagtaatctccctgtacctgtccttcagagctcttgggtgactaggtgctttgttagtgagcagtaatattttgaaatgagtcttttctgagcagtaggtctcaacagtgggtttaaaatattcagtaaaccatgctgttaagagatgtgctgtcatcccagttttgttccatttatagagcatgggcacagtagatttagaataattcttaagcgccctaggacttttacaatggtcagtcttggcttcaaaaacaaagtcgccagctgcattagcccctaacaagagagtcagcttgttctttgaagctttgaaggcaggacttctctctagtgatgaaagtcctagatggcattttcttccaaataagtctgtttcatctccactgaaaatctgttatttagtgtagccaccttcatcaggagtcttatctagatcttctggataacttattgcagcttctacatcagcacttgctgcttcaccttgcacttctgtgttatggagatggcttcttcccttaaacctcatgaaatcaacctctcccaacttttttttcttctgcagcttcttcacctctctcatccttcatagaattgaagacagttgtgggccttgttcttgattaggctttggcctaagagaatgttgtggttggtttgatcttccatccagacaactaaaagttttctccgtatcagcaataaggctgttttgctttatcatttgtgtgctcactggagtagcacttttaatctccttcaagagcttttctttgcattcacaacttggctaactggcacaagaatcttggctttcaatatgccttgcccactaagcttaattatttctagcttttgctttaaagtgagagacctgtgactcttcctttcacttgaatacttaagaggccactgtagggttatttactggcccactttcaatattgttgtctctcaagggatagggagcctgggagttgagggggtggagtggccagtttggggggcagacagaacacacacaacatttattgatttagtttgctgtctttatgggcatgtttcatgacactccaaaacaattaaaatagtaacatcaaaggccactgatcacagatcaccaaacagatataataatttttaatgtttgaatatttaaataattaccaaaatgtgacacagacatgaagtgaacctgtgttcactgttggaaaaatggcaccaatagacttgttcgatgcagggttaccagaaacctttttgttttttttttttaaatactatctgtaagcactactgtacaataaagctatgtatgcctgtattttcattaagttgcagagcaaacgtggtaatatttagctttagttttacttcatctggcataagatcaactccttatataacaagatgataaaagttgtggtgtgcttctataatttcattcaagtagataaagttgaaaaataatgacttgcttttataaacagtatgaagcaatgtagtgcagtaaatgaaattttattccttctttacaatgttctcaaaattatttttatgtttaatccaaataaagagcaagaataaagcaacatttcagattttggtttctggagacaatagttagaaagcatgagttatgagtgacttaaaattcttgttgcctgtacttcactttgaaataacattatgctttaaaaagcattacactgctaaaggttaattagaattctgcagaattactatagctaaaagtaggtaacaagatatctttttttctattgtttaactcctttgtttcagaatgcctattcctgtgcattaaaagtgtccctccaaggaaattaggacatctgcagagttgaaaaacacctaagtctcagtcacttagagtcacacatcagggctcagagtgctatgactaggaaaatgctgacctcctttcattagtatgatcgtgcctttccagcttttgatagatccaagcgctatcttcccaccactcaccaaatgttccacctgtcaaagggtttcaggtccctgcagacttcggttttgacctgtggggaaagtagacttcctcgaactggggaagccacatgttgtacatccttctataaactatgattatcattcttagtaggaaaatatgtgatttctttttttttttttttttttaaagtaagcatcaaatatttgaccaaccagttgggcagagaatatactgaaactttttatataacctcatccaaatgtcccctgcatttaagaaatgaaattcttctaattgcgtttataaattgtaaattatattgcatttagaaattaaaattctttttcttaatttgttttcaaggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggtaggtaaacttgactgcatgtttccaagtgggaattaagactatgagagaattaggcttagctttttgctaagaactagctaagtatctcttttaaaaaacgaatcagtgtgcttccatgatgcttgggttacagttgttctttcttgttttggttttcattcattgcaacttaccgtgaatattctgctcaaggtattgagagtgtgtgttgttatctcaacttacaatttgtgttgaagttatcaaaataatacaaatgataatgcatgactttaaaaaagcatgattactcttagacttttttttttcaaacacaagcaacaaaaaccagtacaagaagttaaaaataaaaatagaagtaggaagttgctttttccaaaaaaactaaacatgtttattcttggatttcttttgtcttaaatagtctggcctctcaatacaaccaggtaatagtaaataatgtgacttttcagtgcagactcttacctttaaagtttctcaggaaatcacactataccaaatggcccaccaaaacatacatgattgttatttgagagttctgcaacctattaccctgcacttccacctgaaatatcttagtttcaaggtgctatactaaaacaagaaagagagaaagaaaatttacgaataagttatttttatgcatttgaaatgccatttggatgggggaaaaagtgttaaaatctcacagtatatgcaactttttaggaaactgtcttgcagagagtatagtgtaaacataacttttatatgcacagggaaactgaaaaatttgtgtgacatttaattgcgatattttaagagttatggaatttttagagctgaaagatttattgatgatgaccaatcaaattgatcttctcatcttgtagatgagggaactgaggccgagacagaagggttcaaattatgcaaggtcaagctcagagtccagatttcccctcatattccccattgctttttttttttttttttgagacagtctcgcgctgttgcccaggctggatcttggctcactgcaacctctgcctcctgggttcaagcaattctcttgtctcagcttcctgagtagctgggactatgggcacacgccaccatgcccggctaatttttgtttttagtagagacagggtttcaccatattggtcaggctggtctcgaactcctgacctcaggtgatccacccgccttggcttcccaaagtgctgggattacaggcgtgagccaccgcgtctggcccccattgctttttccatcagagaaaagtccaggtgtttctagggagttgaagattccactatccccaaggaaatgggctctaaaccattcttgattagaagaggacaggcagagtttaaataaatgaaatttgtggtgaagccagaaatttcattttgctcagcaattaaaacctctgcagactacaacagaagctgctgatggaaattggggtggagcctcatttccccattcatactgacgtggatgagcagtgtgaggaaggaaaccaagagaacagcaggcagcagggtggaaaggaacggactgacccatagatcagagtgtgagcacataaaagcaatgaccccactgtcatgtttggccattgcaccttttgtgatagtatctaagcttatgtccctcaaaacagtgtaagataggttttcattagtatcagcttatttcatttctgctcaaattaatttttaaaaaaatttaattccatatttgagcaaataaagatgtcttcatacttgagtaattcaagaccccttttttgctgctgttgttgttttggtttttttcatggttttgttgttttcttttgttgttgttgtttctttgttttttgagatggagtcttgctctttcacccaggctggagtgcagtggcatgatctccgctcactgcaacctccacctcccaggttcaagcgattctcctacctcactctcagcctcctgagtaactgggattacaggggcataccaccacgcctggctaatttttgtatttttagtagagacagggttttgccatgttggccaggctggtcttgaattcctggcctcaagtgatccgccctccccaacctcccaaggtgctgggattacaggcatgagccaccatgcctggccttcaagagcactttttagtttatttaatataattctctttgttgccggtctgtccgttgaagttgccttctttgatgccagaggccaaagacttggcttcctcgggcttccataacaaagtaacacagatgggtggattaagcaacagaaatttaccctctcacatttctggagtgtaagatcaaggtatcagccaggttggttcctccccaggcatctctccttggtttgcagatgcctgtctgctccctgtatcttcacatgaccttcactctgtttttctgctgtgtcctaacctcttcctacaaggacaccagtcatagtggattaggatcaaccctgatgaccttgtttaactttaataacctcttcgaccctatctgcaaatacagtcacaggtggaggtactggcagcttaggacttcaacatatgaattctagggggacacgttttagcccgtaacagaccccagtgatgctgagcataaaagcaaggcctccacctggagctccttcccctggctgtgcgtgagaccaggtcctacctcagacctaaggaaaaagaatccccaaataggaggctgcgaatctgagtgttgaaaatttccccaaatgaatgagatgtgcagtcggatttgagaatccctgacacatcattttaacactccttccttttagttctccgcgcaagcctcagggagtggaaaatggtatctctcacctcccagataaccggttgccttttaagtgctcttccagctgcctgaattaaaacgctctttttttagtcagtttaccaagcagtgtctcattggacttaaaatgtcagaggagaagttgacactttgacccagattctgacattaatttttaagccaggaggtatccttgcaggagcaaaatcgggaaggatggctgttcagctcttctctcctcattttgctgtctactggagagcaactggaagcctttctagatgaggggctccacctcattcgtgtttgttttgtttatttcctctcagctccttcccctcaagacctttgtgactgtccttcctgaaagcagccctctgtgcagccccatagtgtgtctgtacagcaatgttgaaatagaccacattccgcttttctgtcctcaaaaaagatgtagtttagctgggatggtagaacctgaacacagggagttgcaacccagcctaggcatgttcccaggtgagagagcacggtgggctttcagagcaccatttttcttagcattccagcgtctgcacccacagaagtgatgcttctgcaacatcctcttcctaccttaacaggcactctcaccctcaagtacatggaaatacctttatttccggctctggctaaccttcattaatcagtaaccctacttcagtaagaacaaaaatgagtacatcaatatttccagttggactcacctcagtcactcaggacagaataccattgtacttacataccatcgtgcctgaagaagtcatgatgaaagctttggtttccaggagattttttgtttttagagtgaaaaatgcccgcagaagatcacagagataggaaccctaggaaaaaaactcctgagaacaaatgtataaatgaaacaagcctagaacagtcacataccacttcacactggagagaacgttctgagaaatgtggcatggggcggtttgatcgctgtgcaaacatcataaagtacatgtacataaatctagatggtatagcctgctacacacctgggctacacacctacaactattgctcctaggctccacacctgtgcagcatattgctgcactgaatactatagacagttgtaacacactggcagggatttgcgtatctaaacaaactagaaaaggtacagtaaaaaatacggtattatggggccaccatcatatgtttggtctgtcgtggactaaaatgtcattatgtggcccataactgtatttttattggtagagttgttagcatttggaaatgagcacttgctagttgttgtttttttttttttttttttttttcaaataagcaggaaatattgacttactgaatttacttagccataaggccagagagtcactctgtgagccattggccacgctttcccaaggaggtaactgtgccttattggtgcttcaagcagtgaagcaatagccctttattattaccactccccaaatgtgccctccatgtcagaatagccctctggtggctggaaatctcagcactagctgaattaaccaccttgctcctgttttaggacgttcctgcaaagcccactaatcccaggatctgtttagtagcaagcggtacttttctacattcacatacatagacactggatatttaaaaatacgtattgtagctctttctgctactctccccagacatgtcacctttaataaggagaagttgggggcacagcttctctttattataggatgtgaaaaagttttcctctcacagatctgatcacttgaacaccagaagtctccccgcccccacctcctggttatctcattaatgatctaaataagaagagagttccttttatttggcttttatggaggtatggcatatgactttttctaagtaatatgctgtcacactggtgactgtataaaaagatgtccttagaggtcctttcttcccggccagaagctgacccaccaggatacagacgcactgacgttggcattgtagagtagttggagagagtggtcaggttgaatggaaagccacgataaggaaaagtgagggggggtgcagaacctaggagtggcttacagtgagcagcaggaagagaaattggaagatcaaaggaaagcatcaaaaatgatcacaggccaggcgtggtggctcacacctgtaatcccagcatttggggaggccaaggcaggtggatcacttgaggctaggagttcgagtccagcctggccaacatggtgagaccctgtctctaataaaaatacaaaaaattagccaggcgtggtggcatgcgcctgtagtcgcagctactcaggaggctgaggcaggagaatcgcttgaacccaggagatggaggctgcagtgagccaaaatcacgccactgcactccagcctgggtgacagagcaagactgtcttaaaaaaaaaaaaaattatgaagggatagcaaaggagttcctgaacctgcctgaagaattgcttgatgttggccataaacatagtcaactgccttctagttatatataactatagagagatggcatcaaaattaggaaaacaagcatctatacaactaggtagcaggcagttactgggaggttacgagggataagtcactagcttgaaaacttcctattttctttgcttttattttttttttccgcagacttgtggctcctttgatgtgtcacactattgttgtattgttcgccttagttcccttaccctcctttactcgtctggtccatctcaatgacaggattctgtcgtttggcctgactcagtcccttgtataaaaggacatctattaatccacatcctgctggttactgtacataataaaatgtaaacgtggtgtttcctgcctctcctccaagctcacacacccgcatgtaaatactctaggggcaataggaggagacctagaaactaaggtcacccaaatagaatcttgtccctgcaggcggatagctgagctctaaattactctggatacagtgaaggactaaatggttccaatgaatcaagttcagggagaaaagggtcagggggtatggaggttagccaaagagtgtcaaacgttctcctcaaagctattttagaacaaggctggtcaggctatttgggctcagctcttttcagcgtgtgtcataggcagcagccagttgaagccatgccaccatgcagtgcaggggtccaggtctcaggaaggtgcagcgtaccgagagtcacatgaagacctcagatcatttcctgctgctgtgtaatccaggcagtctgggaagagaatgaatattcagtggttgtatgtatgtgtgtcttcatcccagcaagtgacagatgttcctgcccagttggaaaatggaaattctgacttcattgtcttatcattccttccagaacaagcaccatgggctcaaaccctccctggctctgctttaagggaaataatattgtgtctgtgcagaggccctgtctgcacagggtcgtggtagggctggccttcacatggtggcccatgccactgctgtagcttagccatgaggaagagattggtgagcctgctggagaggaaggctacccttacttggtgctcctcctttatccatagacatgagtactcagattttcgcatctagctttcaaggggctggagattaaagatccaatccatactccttggatgcccttttgtcaagataatcccttcttctgtagctcctaagccctctaaggtctgagggccaagctgccccatggcaggaatggcaaaatgtagctgtcctctcagtggcaaaaggtaataggattatcaagtagcaaaacagaagccaagaaaagacaggagagttagaggtctggattgtgcaccagccttggagcctcgcatctctagcagggcactcttaagcgttaggctttggagtttgaagaggagataaacctatcaaattgccaggtgttcccctgcccttgatgcatgcaaatgattgttgacagccagtgtgatggtagatgtgcctcctggaagaaataaaagtataatattccaacaatcaagcagcattgtggcttttttctacaatcagaaacatagcagctttgtgcttgatctcctaagcaagataattttttttaacctgggcattctttgagttctcagtttcgaggtgatggggagcaaaaatgatgcccaagttcaaatggcgtactgctgcagataggctgtctcctggcacacagatttacagagtgaatgaaatctctcattattggtgctaatctttaaccatggtttttaacttacaagttggaggctaattacacagttaccagttaaagccaggtgacctcatttgttgacaacagtgcacagcaaaggaaagaggagaggataaggaaaatatctgtgatttgctcccagaaggacagtgaagctgagcatccatttgagcagagtcctctgagtactggccttggtcagagcttgttggtgggagtgtgctaaggggagatgcctaggtctgtcattggagtaagctgagggtttggatgcaggggaactcaggcagctctgagccacagggtggtagatgggagggattcacagtggcgcacagtctcttccataaatggaaacgtaagaatcggggcacatggccatggcggctcatgcctgtagtcctagtgctactttaggaggccgaggtaggcggatcacctgaggtcagtttgagaccagcatggccaacatggtgaaaccccatctctactaaaaatacaaaaattagccaggcgtagtggcgggtgcctgtaatcccagctactcgggaggctgaggcaggagaatcacttgaacctgggaggcagaggttgcagtgagccgagattgcctgggcaacaagagcaagactccaactcaaaaaaaatgggcacataatggatggaacattctgtcccaagggatgagggagctgtatatctacctattccagctgccttgggattagccactggtagtcattccacctcactcccagactgaaaagagtcaatcacttcatgaagtggggctatccgaagggaccacaggggacctgattatactgacagatttatttttatttatttactttttttgagacagagtctccctctgttgcccaggccggagtgcagtggcacgatcttggctcactgcagcctcagcctcctgggttcaagcagttcttctgcctcagcctctggagtagctgggactacaggcacgtgctactgtgcctggctaaatttttttgtatttttgttaaagatggggtttcactatgttggccaggcgtgtctcaaactcccgacctcgtgatccacccgccttggcctcccaaaagggctgggattttgagccacctcacctggccttttttttcttggagatggagtctcactctgtctcccaggctggagtgcagtggcacaatcttggctcactgcaaactccaccccccaagttcaagccattctcctgcctccgcctgtggagcagctgggattacaggcgtgcaccaccacgcctggctaatttttgtatttttagtagagacaaggtttcaccatgttggccaggctggtctcaaactcctgacctcaagtgacgcacccacctcaggctcccaaagtgctgggattacaggagtgagccactgcacccggccatattgacagatcttttagtctgaattgttatcagccagtgtggtctagtcatgacatatctagctccatctcgagacctcatgtcttactgctgacactacatcctcgctggtactttttcttccttggcttcaggggcattgctgtgtaggctcagatccatgccagatggggtgtgtagggggaaaagctgcataagggaggaatgtcacttggcaacactcaacaagggggaatgggcctgcagtattctcccagagatgaatgagcagcccattctaggaaatatccctttgaaggaatatcttctctatggtacatccaaacttttctctggaaaacatgcctcttcattctgatgactttctatttattctcttcatcttaccatggttttacaaaagaggaattttaacatactcattcagcagagttaaggacctcctctcttctgcgaacggggagaggtataacaaatatagtaaaacaagaacagccactgcccacgttgtaggggtaagtaccctgcccaacctgcagacagtaaatgccacacacagctctaacagtgacagggggagaaaaacgtcttcagttactggcctgaccttagaggtaaagcaacatattaacagagagggtctgattttaaactttgagctgaacatacttctatagtatcttaattctcagtttttaaaaaattacatcatctagaatggcgtcgtccttgctcttccttttttcttgtgccaaataatagccccctttggtatatgttattgttttaattgattctcaaacctctccttaacattttaacaaacataaaatttgatagaaatgggctagactaaattcagcagtccaggaaatcgagtatttttctacacagatttgagtgtcacccaagatacagtatactttgctgaatctccctccatgatactcttgtggttttatctattttaccaaaacacttccacgtaaaacaggcttccgttgactctgtttgtcctttatggacccaacaggggaggaaaaaataccattgcactgggtttatccacttactgtggagttggggaaccagaaacaaccactggacacgttgcaagcgcgtcaaggtttccaccgccacctggtggctagatggagcacagcatctgtgtaactggtgggcaaaggcgttctgctccaagatgtcaaagtgggggagaaaattatgggtgttctgcaatcttggcaaaagaagagtactgtactccttatctttttactgcttctccatgttcacccttaaaagattgatttttattttttactcagctctcctcttgtttttcaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaccattgtgctggtgtgaatgattccatagtaacaatcttgaccatttactgacgtacagaccagtgagaagtcttcgcatgttgggtacccacacctgttgtgtcttaattgcaagtctgagtaggaagttggggccaacatgtgtctcccagtgctgggaaaatatttcatagacctaatttacagtctttacttgatctaaaacattttgctgccatattttggccctcaagtttgtcccaaatgagagacaaagggaaaagttccagggaaataaaaattaagacagctgattatctgtaaagcatggtttctcatcctgaacgctactaacattttgcagggaataattccttgttgaagggagttgtcctgaccagtgtaggatatttatttattttatttatgttttttgagagtctcgctctgtcacccaggctggagtgcagtggcacaatctcggctcactgcactccagcctgggagacagacgagactccgtctcaataaataaataaataaataaataaataaataaaaggagggcctggcacgaatgacatgcagggaaggcagtgagcaggtggaggtccctgtactcgttgtggtgccttatctaccaggcggttgagttgacgtctttgtggacagaattcgattacaaaggtgtccgaaagtctccaggtgggggagagttttgtagcgggcataatttgggttgtaaattgactgttgtctcctgagcagtctcctggtgagggagagtttcactggagctttgaaacacatgttagacagccttgccctgtagggagtgtctcgtgaaggagaggtaaacaattataattgcatttctaaagggctaagtaggacatgggaaactggaaaatggagaaaagaagagaaaaaaatagtaactcattctctttttcttagaaaaatgaggatacttggtcacatcctcacatggtgaagaataagatggtctcttcatttcccttcaacactagtcccatcgtgaggctctgccctcatgacctaatctaatcctaactgcctcccaaaggtcccacctccacatcccattattggggattagggtttcaacatagggatttgggggaaacacaaacactcagttcatagtgatatctgactgcgattccaaaggtctgaggacacattggccctgttgtttttgctgtgttgtccttggcctcaggtgaacattttagctttagattgcaacattttaagctaaaaacactaagctagaaaattaaacttatctcgtcacattctgcatggtgaacaaactcaaaactcacctgagtgtatcttgttttcatgagaaaaaatgaccggtcatctcccttgccctgttagggacagttagacatgactgctgtatgaagatatgtacatgttaacaattcatatgtacaagctactgttccattttgcctggcccaaggggaggtagctagctagttggggtagcagggcgaattaaccctaatataatagtacatttctaatgccaccaatgaaatgaaaaccagctctcaaacatggcactatatgggatggcattccaaggccaactcagttacagtaactacagctttaactttgatcattttgttaccagaaaggggtcccaatccagaccccaagacagggttcttggatctcatgcaagaaagaattcaaggcgggtccatagaggaaaaggaaatgaagttttaaagaaagtaggaaaataaagagtggttgctccataggcagagtgaacctaagggctgctggttgcccattttattgttatttcttaattatttactaaacaagggctgaattattcatgcctccccttggtagaccatatagggtaacttcctgatgttgccatggcatttgtaaaccgtcatggctctagtgggagtgtagcagtgaggacaaccagaggtcactctcattgctatcttggttttggtgggttttgaccggcttctttactgcaacttgttttatgagcaaggtctttatgacctgtatcttatgcagacctacaatctcatcctgtgacttagaatgacttaaccctctgggaatgcagcccagtaggtcccagccttattttacccagcccctattcaaaatggagttgctctggttcagacgcctctgacaattttaaagctaatgaaaaaaatgtctagccaaatgtatatatacatacatatataattatgaaaagataatgccttataatcttgattcttaaattgaggtatattgatagtattctcccaatggtctggggattaatcaataggtaatttatacaaaactgaagtgctgccaaatagaattataggagtagctgctgcgcaaaaaagattaatgagatttggggagactttgctgtggctaatatgatgggtcaggaagagtacaatctcagtacaattttaagttgtatttatcttatgaataattgggctattctttcatatgcccaagggccattttatagctctatatt

SEQ ID NO: 3 - DNA, 3543 bp, Homo sapien
cgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagca

SEQ ID NO: 4 - DNA, 3355 bp, Homo sapien
agtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagca

SEQ ID NO: 5 - DNA, 2846 bp, Homo sapien
agagttccggaggctttggttgtccattgttagcttagaagttggcgcagtgtgcgtgtgatccacgcctaaatagcacagccttgctgtgcgtggtagaagttgggttagtgttgacatgctgttgactcaccctcccgaggatggaagctctggcctgggtcaagttgtggtcactgcagttaacagtttgttgatctcagggagtattccacagttgctgatgtaattgacaatgattggagccagctcttccccagattcaaatggaccaattagaggacttgttggttctgtttatcaactatgtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattctt

SEQ ID NO: 6 - DNA, 3167 bp, Homo sapien
gcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagca

SEQ ID NO: 7 - DNA, 2366 bp, Homo sapien
gatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcgg

SEQ ID NO: 8 - DNA, 3423 bp, Homo sapien
ggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaaaaaaaa

SEQ ID NO: 9-10 - skipped (2 entries)

SEQ ID NO: 11 - DNA, 20 bp, Artificial sequence
  Primer
cggagcagacacagactatg

SEQ ID NO: 12 - DNA, 21 bp, Artificial sequence
  Primer
cctctacctcatcaccatcct

SEQ ID NO: 13 - DNA, 29 bp, Artificial sequence
  Probe
agtagaagtagcagaggaggaagaagtgg

SEQ ID NO: 14 - DNA, 20 bp, Artificial sequence
  Primer
gacagacagcacaccctaaa

SEQ ID NO: 15 - DNA, 20 bp, Artificial sequence
  Primer
cacacggaggtgtgtcataa

SEQ ID NO: 16 - DNA, 24 bp, Artificial sequence
  Probe
atcccaagaaagccgctcagatcc

SEQ ID NO: 17 - DNA, 21 bp, Artificial sequence
  Primer
cccactttgtgattccctacc

SEQ ID NO: 18 - DNA, 21 bp, Artificial sequence
  Primer
atccatcctctcctggtgtaa

SEQ ID NO: 19 - DNA, 24 bp, Artificial sequence
  Probe
tgatgcccttctcgttcctgacaa

SEQ ID NO: 20 - DNA, 15 bp, Artificial sequence
  Primer
tcgccgcttgctgca

SEQ ID NO: 21 - DNA, 17 bp, Artificial sequence
  Primer
atcggccgtgatgtcga

SEQ ID NO: 22 - DNA, 23 bp, Artificial sequence
  Probe
ccatggtcaaccccaccgtgttc

SEQ ID NO: 23-29 - skipped (7 entries)

SEQ ID NO: 30 - DNA, 20 bp, Artificial sequence
  Synthetic oligonucleotide
ggttaagtttcaactcattc

SEQ ID NO: 31 - DNA, 20 bp, Artificial sequence
  Synthetic oligonucleotide
cctttcaatattgttcttcc

SEQ ID NO: 32 - DNA, 20 bp, Artificial sequence
  Synthetic oligonucleotide
gcctcattttctatgcatcc

SEQ ID NO: 33 - DNA, 20 bp, Artificial sequence
  Synthetic oligonucleotide
tgcatcaattcctttgggtt

SEQ ID NO: 34 - DNA, 20 bp, Artificial sequence
  Synthetic oligonucleotide
acactctttgcttacccact

SEQ ID NO: 35 - DNA, 20 bp, Artificial sequence
  Synthetic oligonucleotide
cgtgtgtatcctcttaattc

SEQ ID NO: 36 - DNA, 20 bp, Artificial sequence
  Synthetic oligonucleotide
tcaagtttacctacctccac

SEQ ID NO: 37 - DNA, 20 bp, Artificial sequence
  Synthetic oligonucleotide
tgtgtcataacctgcatcaa

SEQ ID NO: 38 - DNA, 20 bp, Artificial sequence
  Synthetic oligonucleotide
accaacttcatcctgaatct

SEQ ID NO: 39 - DNA, 20 bp, Artificial sequence
  Synthetic oligonucleotide
agcgcactattctctcttgt

SEQ ID NO: 40 - DNA, 20 bp, Artificial sequence
  Synthetic oligonucleotide
agtacatattcattcaatct

SEQ ID NO: 41 - DNA, 20 bp, Artificial sequence
  Synthetic oligonucleotide
tactactcttatcatgacca

SEQ ID NO: 42 - DNA, 20 bp, Artificial sequence
  Synthetic oligonucleotide
aattcgatccttttatctgc

SEQ ID NO: 43 - DNA, 20 bp, Artificial sequence
  Synthetic oligonucleotide
ccatcaattgtcaccacctc

SEQ ID NO: 44 - DNA, 20 bp, Artificial sequence
  Synthetic oligonucleotide
cccaacatctcaagctgtct

SEQ ID NO: 45 - DNA, 20 bp, Artificial sequence
  Synthetic oligonucleotide
gagcactccatttcatattc

SEQ ID NO: 46 - DNA, 20 bp, Artificial sequence
  Synthetic oligonucleotide
tggttatctacaatgtgcaa

SEQ ID NO: 47 - DNA, 20 bp, Artificial sequence
  Synthetic oligonucleotide
gtcacactatactttgttat

SEQ ID NO: 48 - DNA, 20 bp, Artificial sequence
  Synthetic oligonucleotide
tggtggattacctcgaacca

SEQ ID NO: 49 - DNA, 20 bp, Artificial sequence
  Synthetic oligonucleotide
tttcacataccatactcaga

SEQ ID NO: 50 - DNA, 20 bp, Artificial sequence
  Synthetic oligonucleotide
gaactcaaaaatactgctcc

SEQ ID NO: 51 - DNA, 20 bp, Artificial sequence
  Synthetic oligonucleotide
gacacttgaaaattcacact

SEQ ID NO: 52 - DNA, 20 bp, Artificial sequence
  Synthetic oligonucleotide
gggcacacttcccttcagtc

SEQ ID NO: 53 - DNA, 20 bp, Artificial sequence
  Synthetic oligonucleotide
tgcaaatttcatcaccaaac

SEQ ID NO: 54 - DNA, 20 bp, Artificial sequence
  Synthetic oligonucleotide
acttaccaacttcatcctga

SEQ ID NO: 55 - DNA, 20 bp, Artificial sequence
  Synthetic oligonucleotide
tttgcatattcatacttgga

SEQ ID NO: 56 - DNA, 20 bp, Artificial sequence
  Synthetic oligonucleotide
atgtcaacactaacccaact

SEQ ID NO: 57 - DNA, 20 bp, Artificial sequence
  Synthetic oligonucleotide
tactcacttacatagttgat

SEQ ID NO: 58 - DNA, 20 bp, Artificial sequence
  Synthetic oligonucleotide
ccaaaacttctttctaggcc

SEQ ID NO: 59 - DNA, 20 bp, Artificial sequence
  Synthetic oligonucleotide
gttctctctaaatatcagct

SEQ ID NO: 60 - DNA, 20 bp, Artificial sequence
  Synthetic oligonucleotide
cacttacaaactcaccaact

SEQ ID NO: 61 - DNA, 20 bp, Artificial sequence
  Synthetic oligonucleotide
caggacttacttcttggcaa

SEQ ID NO: 62 - DNA, 20 bp, Artificial sequence
  Synthetic oligonucleotide
atgttcattctcatccccag

SEQ ID NO: 63 - DNA, 20 bp, Artificial sequence
  Synthetic oligonucleotide
gccactatttgctacacaat

SEQ ID NO: 64 - DNA, 20 bp, Artificial sequence
  Synthetic oligonucleotide
tcagactgtttcctccagtt

SEQ ID NO: 65 - DNA, 20 bp, Artificial sequence
  Synthetic oligonucleotide
gcatgctaaatcagttctct

SEQ ID NO: 66 - DNA, 20 bp, Artificial sequence
  Synthetic oligonucleotide
gtttcagtatattctctgcc

SEQ ID NO: 67 - DNA, 20 bp, Artificial sequence
  Synthetic oligonucleotide
gccagaatgtacttccttat

SEQ ID NO: 68 - DNA, 20 bp, Artificial sequence
  Synthetic oligonucleotide
tccattttacctcatacact

SEQ ID NO: 69 - DNA, 20 bp, Artificial sequence
  Synthetic oligonucleotide
ggatctttaatctccagccc

SEQ ID NO: 70 - DNA, 20 bp, Artificial sequence
  Synthetic oligonucleotide
accacaacttttatcatctt

SEQ ID NO: 71 - DNA, 20 bp, Artificial sequence
  Synthetic oligonucleotide
cctacagtatttctcattca

SEQ ID NO: 72 - DNA, 20 bp, Artificial sequence
  Synthetic oligonucleotide
gctcattttttttacatgac

SEQ ID NO: 73 - DNA, 20 bp, Artificial sequence
  Synthetic oligonucleotide
aagctttccacatttgctta

SEQ ID NO: 74 - DNA, 20 bp, Artificial sequence
  Synthetic oligonucleotide
caacaatctgcaactcttct

SEQ ID NO: 75 - DNA, 20 bp, Artificial sequence
  Synthetic oligonucleotide
gttgaatttcttacactttc

SEQ ID NO: 76 - DNA, 20 bp, Artificial sequence
  Synthetic oligonucleotide
cgccattattatttcaactc

SEQ ID NO: 77 - DNA, 20 bp, Artificial sequence
  Synthetic oligonucleotide
cgagtcatcctcctccgcat

SEQ ID NO: 78 - DNA, 20 bp, Artificial sequence
  Synthetic oligonucleotide
ccctcattagatttcctcca

SEQ ID NO: 79 - DNA, 20 bp, Artificial sequence
  Synthetic oligonucleotide
ccatgatgttccttcctggc

SEQ ID NO: 80 - DNA, 20 bp, Artificial sequence
  Synthetic oligonucleotide
tgagtctgttacttctggta

SEQ ID NO: 81 - DNA, 20 bp, Artificial sequence
  Synthetic oligonucleotide
gcagtgaccacaacttgacc

SEQ ID NO: 82 - DNA, 20 bp, Artificial sequence
  Synthetic oligonucleotide
ccaggctgaactctccattc

SEQ ID NO: 83 - DNA, 20 bp, Artificial sequence
  Synthetic oligonucleotide
ggcaacacacaaactctacc

SEQ ID NO: 84 - DNA, 20 bp, Artificial sequence
  Synthetic oligonucleotide
tgtcctatttattcctcatc

SEQ ID NO: 85 - DNA, 20 bp, Artificial sequence
  Synthetic oligonucleotide
ttgtaattccttttttggat

SEQ ID NO: 86 - DNA, 20 bp, Artificial sequence
  Synthetic oligonucleotide
tccgtcttaatcttcactca

SEQ ID NO: 87 - DNA, 20 bp, Artificial sequence
  Synthetic oligonucleotide
tacatcattttcttgcagtc

SEQ ID NO: 88 - DNA, 20 bp, Artificial sequence
  Synthetic oligonucleotide
tcatcaccatacatagcagc

SEQ ID NO: 89 - DNA, 20 bp, Artificial sequence
  Synthetic oligonucleotide
agaacagcttacttaccaac

SEQ ID NO: 90 - DNA, 20 bp, Artificial sequence
  Synthetic oligonucleotide
atgaacatgtcacttaggct

SEQ ID NO: 91 - DNA, 20 bp, Artificial sequence
  Synthetic oligonucleotide
tggtctatatatttcaggca

SEQ ID NO: 92 - DNA, 20 bp, Artificial sequence
  Synthetic oligonucleotide
gtattcttttccttgccgtt

SEQ ID NO: 93 - DNA, 20 bp, Artificial sequence
  Synthetic oligonucleotide
tctgctttattacttggata

SEQ ID NO: 94 - DNA, 20 bp, Artificial sequence
  Synthetic oligonucleotide
tcgcaaacatccatcctctc

SEQ ID NO: 95 - DNA, 20 bp, Artificial sequence
  Synthetic oligonucleotide
gctgacattctaacatttca

SEQ ID NO: 96 - DNA, 20 bp, Artificial sequence
  Synthetic oligonucleotide
gtcgctatgacaacaccgcc

SEQ ID NO: 97 - DNA, 20 bp, Artificial sequence
  Synthetic oligonucleotide
ctttccaacctattaccatc

SEQ ID NO: 98 - DNA, 20 bp, Artificial sequence
  Synthetic oligonucleotide
actgtatttcttctacatcc

SEQ ID NO: 99 - DNA, 20 bp, Artificial sequence
  Synthetic oligonucleotide
gctgatattctcactttatc

SEQ ID NO: 100 - DNA, 20 bp, Artificial sequence
  Synthetic oligonucleotide
acagctaaattctttacagt

SEQ ID NO: 101 - DNA, 20 bp, Artificial sequence
  Synthetic oligonucleotide
accgcagaagacatcaagga

SEQ ID NO: 102 - DNA, 20 bp, Artificial sequence
  Synthetic oligonucleotide
tcatcaatatacagtatgca

SEQ ID NO: 103 - DNA, 20 bp, Artificial sequence
  Synthetic oligonucleotide
cccaacttctaccacgcaca

SEQ ID NO: 104 - DNA, 20 bp, Artificial sequence
  Synthetic oligonucleotide
acttcgattatttaatgtct

SEQ ID NO: 105 - DNA, 20 bp, Artificial sequence
  Synthetic oligonucleotide
ttcaacttgtccacggactt

SEQ ID NO: 106 - DNA, 20 bp, Artificial sequence
  Synthetic oligonucleotide
atgtactaatatccagtggc

SEQ ID NO: 107 - DNA, 20 bp, Artificial sequence
  Synthetic oligonucleotide
gcatccatcttcacttcaga

SEQ ID NO: 108 - DNA, 20 bp, Artificial sequence
  Synthetic oligonucleotide
cgtctctttatcactttact

SEQ ID NO: 109 - DNA, 20 bp, Artificial sequence
  Synthetic oligonucleotide
gctcaatttgcacaaatctc

SEQ ID NO: 110 - DNA, 20 bp, Artificial sequence
  Synthetic oligonucleotide
gcacaattattgtttcctct

SEQ ID NO: 111 - DNA, 20 bp, Artificial sequence
  Synthetic oligonucleotide
gcttacatcattttcttgca

SEQ ID NO: 112 - DNA, 20 bp, Artificial sequence
  Synthetic oligonucleotide
gtgtacatattcatgtcaca

SEQ ID NO: 113 - DNA, 20 bp, Artificial sequence
  Synthetic oligonucleotide
tggtactatttctaaggaat

SEQ ID NO: 114 - DNA, 20 bp, Artificial sequence
  Synthetic oligonucleotide
ttgtaagacactctttgctt

SEQ ID NO: 115 - DNA, 20 bp, Artificial sequence
  Synthetic oligonucleotide
aggacattcatttttgacca

SEQ ID NO: 116 - DNA, 20 bp, Artificial sequence
  Synthetic oligonucleotide
gtgaacataacttcaagctt

SEQ ID NO: 117 - DNA, 20 bp, Artificial sequence
  Synthetic oligonucleotide
actaacccaacttctaccac

SEQ ID NO: 118 - DNA, 20 bp, Artificial sequence
  Synthetic oligonucleotide
atcaacaaactgttaactgc

SEQ ID NO: 119 - DNA, 20 bp, Artificial sequence
  Synthetic oligonucleotide
gagagaatctattcatgcac

SEQ ID NO: 120 - DNA, 20 bp, Artificial sequence
  Synthetic oligonucleotide
gccaatacatctgtcattct

SEQ ID NO: 121 - DNA, 20 bp, Artificial sequence
  Synthetic oligonucleotide
atgtatttctacctctaggc

SEQ ID NO: 122 - DNA, 20 bp, Artificial sequence
  Synthetic oligonucleotide
actgtcactctcacgcccct

SEQ ID NO: 123 - DNA, 20 bp, Artificial sequence
  Synthetic oligonucleotide
ccttataccacttctctgta

SEQ ID NO: 124 - DNA, 20 bp, Artificial sequence
  Synthetic oligonucleotide
agtttcgcaaacatccatcc

SEQ ID NO: 125 - DNA, 20 bp, Artificial sequence
  Synthetic oligonucleotide
caacaaatgccatcagtctc

SEQ ID NO: 126 - DNA, 20 bp, Artificial sequence
  Synthetic oligonucleotide
gcagcatatacaaggtacaa

SEQ ID NO: 127 - DNA, 20 bp, Artificial sequence
  Synthetic oligonucleotide
tgtcgctatgacaacaccgc

SEQ ID NO: 128 - DNA, 20 bp, Artificial sequence
  Synthetic oligonucleotide
tccatctgtatcacagtgtt

SEQ ID NO: 129 - DNA, 20 bp, Artificial sequence
  Synthetic oligonucleotide
cttacttaccaacttcatcc

SEQ ID NO: 130 - DNA, 20 bp, Artificial sequence
  Synthetic oligonucleotide
tctagtatttcactagtgca

SEQ ID NO: 131 - DNA, 20 bp, Artificial sequence
  Synthetic oligonucleotide
ttgctttgatctttcaggta

SEQ ID NO: 132 - DNA, 20 bp, Artificial sequence
  Synthetic oligonucleotide
ttcaactttatctacttgaa

SEQ ID NO: 133 - DNA, 20 bp, Artificial sequence
  Synthetic oligonucleotide
gtactgtatttcttctacat

SEQ ID NO: 134 - DNA, 20 bp, Artificial sequence
  Synthetic oligonucleotide
actaacatttgctactgcac

SEQ ID NO: 135 - DNA, 20 bp, Artificial sequence
  Synthetic oligonucleotide
gttcacatttcagaccacca

SEQ ID NO: 136 - DNA, 20 bp, Artificial sequence
  Synthetic oligonucleotide
acttgcatttcaagttccca

SEQ ID NO: 137 - DNA, 20 bp, Artificial sequence
  Synthetic oligonucleotide
gcagcagtacaaaccacatc

SEQ ID NO: 138 - DNA, 20 bp, Artificial sequence
  Synthetic oligonucleotide
acaggacttacttcttggca

SEQ ID NO: 139 - DNA, 20 bp, Artificial sequence
  Synthetic oligonucleotide
ttcaatatacaccctgggta

SEQ ID NO: 140 - DNA, 20 bp, Artificial sequence
  Synthetic oligonucleotide
gaccagtattattccatcta

SEQ ID NO: 141 - DNA, 20 bp, Artificial sequence
  Synthetic oligonucleotide
gctctcataatatcctcatc

SEQ ID NO: 142 - DNA, 20 bp, Artificial sequence
  Synthetic oligonucleotide
cccatattatctatggacaa

SEQ ID NO: 143 - DNA, 20 bp, Artificial sequence
  Synthetic oligonucleotide
aacttcatatcctgagtcat

SEQ ID NO: 144 - DNA, 20 bp, Artificial sequence
  Synthetic oligonucleotide
gtcaacaatcatttgcatgc

SEQ ID NO: 145 - DNA, 20 bp, Artificial sequence
  Synthetic oligonucleotide
tacaccttatcaatgcaact

SEQ ID NO: 146 - DNA, 20 bp, Artificial sequence
  Synthetic oligonucleotide
tctacctttgcaattttcta

SEQ ID NO: 147 - DNA, 20 bp, Artificial sequence
  Synthetic oligonucleotide
ggacagtttccctttctcat

SEQ ID NO: 148 - DNA, 20 bp, Artificial sequence
  Synthetic oligonucleotide
gcacaaattttatcacatcc

SEQ ID NO: 149 - DNA, 20 bp, Artificial sequence
  Synthetic oligonucleotide
gcctactatatgctcaacat

SEQ ID NO: 150 - DNA, 20 bp, Artificial sequence
  Synthetic oligonucleotide
agattacttcttttcctgca

SEQ ID NO: 151 - DNA, 20 bp, Artificial sequence
  Synthetic oligonucleotide
tgggcaacacacaaactcta

SEQ ID NO: 152 - DNA, 20 bp, Artificial sequence
  Synthetic oligonucleotide
ccacacattttccttgtgaa

SEQ ID NO: 153 - DNA, 20 bp, Artificial sequence
  Synthetic oligonucleotide
tacttcgattatttaatgtc

SEQ ID NO: 154 - DNA, 20 bp, Artificial sequence
  Synthetic oligonucleotide
gtgagctaacatttttcctc

SEQ ID NO: 155 - DNA, 20 bp, Artificial sequence
  Synthetic oligonucleotide
tggtactttttaatcagttc

SEQ ID NO: 156 - DNA, 20 bp, Artificial sequence
  Synthetic oligonucleotide
agttactgtcacaacaaggc

SEQ ID NO: 157 - DNA, 20 bp, Artificial sequence
  Synthetic oligonucleotide
gcatgttcattctcatcccc

SEQ ID NO: 158 - DNA, 20 bp, Artificial sequence
  Synthetic oligonucleotide
ttttcacataccatactcag

SEQ ID NO: 159 - DNA, 20 bp, Artificial sequence
  Synthetic oligonucleotide
ccatcaatgtccatttagca

SEQ ID NO: 160 - DNA, 20 bp, Artificial sequence
  Synthetic oligonucleotide
gtacaatcatcctgcagaaa

SEQ ID NO: 161 - DNA, 20 bp, Artificial sequence
  Synthetic oligonucleotide
cccaaaacttctttctaggc

SEQ ID NO: 162 - DNA, 20 bp, Artificial sequence
  Synthetic oligonucleotide
ccaagtattttcctgcatca

SEQ ID NO: 163 - DNA, 20 bp, Artificial sequence
  Synthetic oligonucleotide
gccttattatctcaaactca

SEQ ID NO: 164 - DNA, 20 bp, Artificial sequence
  Synthetic oligonucleotide
gtctcattttccaatcatag

SEQ ID NO: 165 - DNA, 20 bp, Artificial sequence
  Synthetic oligonucleotide
gtactcacttacatagttga

SEQ ID NO: 166 - DNA, 20 bp, Artificial sequence
  Synthetic oligonucleotide
ctgtaatttgtattcacact

SEQ ID NO: 167 - DNA, 20 bp, Artificial sequence
  Synthetic oligonucleotide
tcatcctgaatctcctcggc

SEQ ID NO: 168 - DNA, 20 bp, Artificial sequence
  Synthetic oligonucleotide
gcaacttattacaactctca

SEQ ID NO: 169 - DNA, 20 bp, Artificial sequence
  Synthetic oligonucleotide
ctcaattcgatccttttatc

SEQ ID NO: 170 - DNA, 20 bp, Artificial sequence
  Synthetic oligonucleotide
agcatgtcaacactaaccca

SEQ ID NO: 171 - DNA, 20 bp, Artificial sequence
  Synthetic oligonucleotide
ccatatctttcaatcctgcc

SEQ ID NO: 172 - DNA, 20 bp, Artificial sequence
  Synthetic oligonucleotide
tcacttacaaactcaccaac

SEQ ID NO: 173 - DNA, 20 bp, Artificial sequence
  Synthetic oligonucleotide
gccaaatatttcacagcaat

SEQ ID NO: 174 - DNA, 20 bp, Artificial sequence
  Synthetic oligonucleotide
tccgagtcatcctcctccgc

SEQ ID NO: 175 - DNA, 20 bp, Artificial sequence
  Synthetic oligonucleotide
aggcttattcatcttttccc

SEQ ID NO: 176 - DNA, 20 bp, Artificial sequence
  Synthetic oligonucleotide
acaggagcatcctctttttc

SEQ ID NO: 177 - DNA, 20 bp, Artificial sequence
  Synthetic oligonucleotide
gtcaagtttacctacctcca

SEQ ID NO: 178 - DNA, 20 bp, Artificial sequence
  Synthetic oligonucleotide
gcagatatttcaatatacag

SEQ ID NO: 179 - DNA, 20 bp, Artificial sequence
  Synthetic oligonucleotide
ttgctccaacaatctgcaac

SEQ ID NO: 180 - DNA, 20 bp, Artificial sequence
  Synthetic oligonucleotide
ttctgcaaagaacaccttga

SEQ ID NO: 181 - DNA, 20 bp, Artificial sequence
  Synthetic oligonucleotide
ttggattcatctccatactc

SEQ ID NO: 182 - DNA, 20 bp, Artificial sequence
  Synthetic oligonucleotide
tggtcattactacttacaca

SEQ ID NO: 183 - DNA, 20 bp, Artificial sequence
  Synthetic oligonucleotide
ttggtctttttttaccccga

SEQ ID NO: 184 - DNA, 20 bp, Artificial sequence
  Synthetic oligonucleotide
aactaattatcagatatgca

SEQ ID NO: 185 - DNA, 20 bp, Artificial sequence
  Synthetic oligonucleotide
gtaagctttccacatttgct

SEQ ID NO: 186 - DNA, 20 bp, Artificial sequence
  Synthetic oligonucleotide
gccacttccattttcatctt

SEQ ID NO: 187 - DNA, 20 bp, Artificial sequence
  Synthetic oligonucleotide
gtactgtttcttcttcagca

SEQ ID NO: 188 - DNA, 20 bp, Artificial sequence
  Synthetic oligonucleotide
gcatcatatatatacttctt

SEQ ID NO: 189 - DNA, 20 bp, Artificial sequence
  Synthetic oligonucleotide
tttgacttgtttttcaccac

SEQ ID NO: 190 - DNA, 20 bp, Artificial sequence
  Synthetic oligonucleotide
gtagttcatacttcctactc

SEQ ID NO: 191 - DNA, 20 bp, Artificial sequence
  Synthetic oligonucleotide
tgaacccacatcttctgcaa

SEQ ID NO: 192 - DNA, 20 bp, Artificial sequence
  Synthetic oligonucleotide
gcctaattctctcatagtct

SEQ ID NO: 193 - DNA, 20 bp, Artificial sequence
  Synthetic oligonucleotide
tgtcacaatattcatactta

SEQ ID NO: 194 - DNA, 20 bp, Artificial sequence
  Synthetic oligonucleotide
ccgccatatctttcaatcct

SEQ ID NO: 195 - DNA, 20 bp, Artificial sequence
  Synthetic oligonucleotide
ttgtcaattacatcagcaac

SEQ ID NO: 196 - DNA, 20 bp, Artificial sequence
  Synthetic oligonucleotide
ctgtacaatcatcctgcaga

SEQ ID NO: 197 - DNA, 20 bp, Artificial sequence
  Synthetic oligonucleotide
ctacaattatccacatggca

SEQ ID NO: 198 - DNA, 20 bp, Artificial sequence
  Synthetic oligonucleotide
agtcactcaaactttgattt

SEQ ID NO: 199 - DNA, 20 bp, Artificial sequence
  Synthetic oligonucleotide
tccaatttgcaacctcattc

SEQ ID NO: 200 - DNA, 20 bp, Artificial sequence
  Synthetic oligonucleotide
gcattcattctatttggtgc

SEQ ID NO: 201 - DNA, 20 bp, Artificial sequence
  Synthetic oligonucleotide
gcaacagatctcttattctc

SEQ ID NO: 202 - DNA, 20 bp, Artificial sequence
  Synthetic oligonucleotide
ggtgaacataacttcaagct

SEQ ID NO: 203 - DNA, 20 bp, Artificial sequence
  Synthetic oligonucleotide
cacatcttacctgtcaacat

SEQ ID NO: 204 - DNA, 20 bp, Artificial sequence
  Synthetic oligonucleotide
cggacttttttcttcttgct

SEQ ID NO: 205 - DNA, 20 bp, Artificial sequence
  Synthetic oligonucleotide
caccatctataataccatct

SEQ ID NO: 206 - DNA, 20 bp, Artificial sequence
  Synthetic oligonucleotide
gtagactgtcactctcacgc

SEQ ID NO: 207 - DNA, 20 bp, Artificial sequence
  Synthetic oligonucleotide
tgaacttcatatcctgagtc

SEQ ID NO: 208 - DNA, 20 bp, Artificial sequence
  Synthetic oligonucleotide
gtctacccattttcctctat

SEQ ID NO: 209 - DNA, 20 bp, Artificial sequence
  Synthetic oligonucleotide
acaacaaatgccatcagtct

SEQ ID NO: 210 - DNA, 20 bp, Artificial sequence
  Synthetic oligonucleotide
tgctgatctgatttccaact

SEQ ID NO: 211 - DNA, 20 bp, Artificial sequence
  Synthetic oligonucleotide
gttttctacactctcttcat

SEQ ID NO: 212 - DNA, 20 bp, Artificial sequence
  Synthetic oligonucleotide
gtcacatgatatttcagata

SEQ ID NO: 213 - DNA, 20 bp, Artificial sequence
  Synthetic oligonucleotide
ttcacaatatttgcaacaca

SEQ ID NO: 214 - DNA, 20 bp, Artificial sequence
  Synthetic oligonucleotide
ccatcacatcttttaatgct

SEQ ID NO: 215 - DNA, 20 bp, Artificial sequence
  Synthetic oligonucleotide
acatccgagtcatcctcctc

SEQ ID NO: 216 - DNA, 20 bp, Artificial sequence
  Synthetic oligonucleotide
acccatattatctatggaca

SEQ ID NO: 217 - DNA, 20 bp, Artificial sequence
  Synthetic oligonucleotide
gacatcatttaatttgtgct

SEQ ID NO: 218 - DNA, 20 bp, Artificial sequence
  Synthetic oligonucleotide
acagcatgatattcctcacc

SEQ ID NO: 219 - DNA, 20 bp, Artificial sequence
  Synthetic oligonucleotide
gttcacatttcttacaacac

SEQ ID NO: 220 - DNA, 20 bp, Artificial sequence
  Synthetic oligonucleotide
cagtactcacttacatagtt

SEQ ID NO: 221 - DNA, 20 bp, Artificial sequence
  Synthetic oligonucleotide
aacttcatcctgaatctcct

SEQ ID NO: 222 - DNA, 20 bp, Artificial sequence
  Synthetic oligonucleotide
gtgatctttttcagacaacc

SEQ ID NO: 223 - DNA, 20 bp, Artificial sequence
  Synthetic oligonucleotide
cactaacccaacttctacca

SEQ ID NO: 224 - DNA, 20 bp, Artificial sequence
  Synthetic oligonucleotide
gtacattccactttgtttta

SEQ ID NO: 225 - DNA, 20 bp, Artificial sequence
  Synthetic oligonucleotide
gttgacatatacctacctat

SEQ ID NO: 226 - DNA, 20 bp, Artificial sequence
  Synthetic oligonucleotide
gctagccaatacatctgtca

SEQ ID NO: 227 - DNA, 20 bp, Artificial sequence
  Synthetic oligonucleotide
gtttcaactatattcctact

SEQ ID NO: 228 - DNA, 20 bp, Artificial sequence
  Synthetic oligonucleotide
tcaggcatctacttgtgtta

SEQ ID NO: 229 - DNA, 20 bp, Artificial sequence
  Synthetic oligonucleotide
tccttataccacttctctgt

SEQ ID NO: 230 - DNA, 20 bp, Artificial sequence
  Synthetic oligonucleotide
tggtcaattctcttgaacaa

SEQ ID NO: 231 - DNA, 20 bp, Artificial sequence
  Synthetic oligonucleotide
tggttcatttctttagccac

SEQ ID NO: 232 - DNA, 20 bp, Artificial sequence
  Synthetic oligonucleotide
aacctattaccatctggcct

SEQ ID NO: 233 - DNA, 20 bp, Artificial sequence
  Synthetic oligonucleotide
agctacttcactgttctacc

SEQ ID NO: 234 - DNA, 20 bp, Artificial sequence
  Synthetic oligonucleotide
ctgaactttctaacttgcaa

SEQ ID NO: 235 - DNA, 20 bp, Artificial sequence
  Synthetic oligonucleotide
attgtcactttcttcagcca

SEQ ID NO: 236 - DNA, 20 bp, Artificial sequence
  Synthetic oligonucleotide
gttcatactcctttcaagat

SEQ ID NO: 237 - DNA, 20 bp, Artificial sequence
  Synthetic oligonucleotide
acagcatgtcaacactaacc

SEQ ID NO: 238 - DNA, 20 bp, Artificial sequence
  Synthetic oligonucleotide
atgtgatttcactaaccggc

SEQ ID NO: 239 - DNA, 20 bp, Artificial sequence
  Synthetic oligonucleotide
gcttgaattactattgatct

SEQ ID NO: 240 - DNA, 20 bp, Artificial sequence
  Synthetic oligonucleotide
tggataactgccttcttatc

SEQ ID NO: 241 - DNA, 20 bp, Artificial sequence
  Synthetic oligonucleotide
gcaccatttcctcatccaat

SEQ ID NO: 242 - DNA, 20 bp, Artificial sequence
  Synthetic oligonucleotide
gtgcttataactctcatact

SEQ ID NO: 243 - DNA, 20 bp, Artificial sequence
  Synthetic oligonucleotide
gcttacttaccaacttcatc

SEQ ID NO: 244 - DNA, 20 bp, Artificial sequence
  Synthetic oligonucleotide
gtttctttacccacatcttc

SEQ ID NO: 245 - DNA, 20 bp, Artificial sequence
  Synthetic oligonucleotide
gttgtgttatccatatccta

SEQ ID NO: 246 - DNA, 20 bp, Artificial sequence
  Synthetic oligonucleotide
agcttacatcattttcttgc

SEQ ID NO: 247 - DNA, 20 bp, Artificial sequence
  Synthetic oligonucleotide
actgcactattagtcatatc

SEQ ID NO: 248 - DNA, 20 bp, Artificial sequence
  Synthetic oligonucleotide
gcactacattgcttcatact

SEQ ID NO: 249 - DNA, 20 bp, Artificial sequence
  Synthetic oligonucleotide
tccttatttcactatctatc

SEQ ID NO: 250 - DNA, 20 bp, Artificial sequence
  Synthetic oligonucleotide
gttttcacataccatactca

SEQ ID NO: 251 - DNA, 20 bp, Artificial sequence
  Synthetic oligonucleotide
gtcttctcttatgtcaccaa

SEQ ID NO: 252 - DNA, 20 bp, Artificial sequence
  Synthetic oligonucleotide
atcacttacaaactcaccaa

SEQ ID NO: 253 - DNA, 20 bp, Artificial sequence
  Synthetic oligonucleotide
agttccttttcacctatcct

SEQ ID NO: 254 - DNA, 20 bp, Artificial sequence
  Synthetic oligonucleotide
gtccaaaacacagtacaaca

SEQ ID NO: 255 - DNA, 20 bp, Artificial sequence
  Synthetic oligonucleotide
ggctacatcctcaattcatt

SEQ ID NO: 256 - DNA, 20 bp, Artificial sequence
  Synthetic oligonucleotide
caggacaaccaattagtttt

SEQ ID NO: 257 - DNA, 20 bp, Artificial sequence
  Synthetic oligonucleotide
ccggacatgttttcttttac

SEQ ID NO: 258 - DNA, 20 bp, Artificial sequence
  Synthetic oligonucleotide
gtaatttcaatatacaccct

SEQ ID NO: 259 - DNA, 20 bp, Artificial sequence
  Synthetic oligonucleotide
ccacaagaataatatacaac

SEQ ID NO: 260 - DNA, 20 bp, Artificial sequence
  Synthetic oligonucleotide
cccgtcattccatctgtatc

SEQ ID NO: 261 - DNA, 20 bp, Artificial sequence
  Synthetic oligonucleotide
cactcaattcgatcctttta

SEQ ID NO: 262 - DNA, 20 bp, Artificial sequence
  Synthetic oligonucleotide
gcttaatacatcctgttcaa

SEQ ID NO: 263 - DNA, 20 bp, Artificial sequence
  Synthetic oligonucleotide
acagctattttaatgtcatc

SEQ ID NO: 264 - DNA, 20 bp, Artificial sequence
  Synthetic oligonucleotide
ccaccagacatccgagtcat

SEQ ID NO: 265 - DNA, 20 bp, Artificial sequence
  Synthetic oligonucleotide
gctacactatcaatcttgaa

SEQ ID NO: 266 - DNA, 20 bp, Artificial sequence
  Synthetic oligonucleotide
attgccacttccattttcat

SEQ ID NO: 267 - DNA, 20 bp, Artificial sequence
  Synthetic oligonucleotide
gcttgcttaccttctagttc

SEQ ID NO: 268 - DNA, 20 bp, Artificial sequence
  Synthetic oligonucleotide
caacagcatgtcaacactaa

SEQ ID NO: 269 - DNA, 20 bp, Artificial sequence
  Synthetic oligonucleotide
agcatcatatatatacttct

SEQ ID NO: 270 - DNA, 20 bp, Artificial sequence
  Synthetic oligonucleotide
ccaacttcatcctgaatctc

SEQ ID NO: 271 - DNA, 20 bp, Artificial sequence
  Synthetic oligonucleotide
gcaggacaaccaattagttt

SEQ ID NO: 272 - DNA, 20 bp, Artificial sequence
  Synthetic oligonucleotide
gcatcttttactatctgcca

SEQ ID NO: 273 - DNA, 20 bp, Artificial sequence
  Synthetic oligonucleotide
gcattctcttatattcctta

SEQ ID NO: 274 - DNA, 20 bp, Artificial sequence
  Synthetic oligonucleotide
acattgtcactttcttcagc

SEQ ID NO: 275 - DNA, 20 bp, Artificial sequence
  Synthetic oligonucleotide
gtttacctacctccaccaca

SEQ ID NO: 276 - DNA, 20 bp, Artificial sequence
  Synthetic oligonucleotide
aagggcatcacttacaaact

SEQ ID NO: 277 - DNA, 20 bp, Artificial sequence
  Synthetic oligonucleotide
aatgtacttccttataccac

SEQ ID NO: 278 - DNA, 20 bp, Artificial sequence
  Synthetic oligonucleotide
ggctatattctctcttcaat

SEQ ID NO: 279 - DNA, 20 bp, Artificial sequence
  Synthetic oligonucleotide
agcttacttaccaacttcat

SEQ ID NO: 280 - DNA, 20 bp, Artificial sequence
  Synthetic oligonucleotide
tactgcactacattgcttca

SEQ ID NO: 281 - DNA, 20 bp, Artificial sequence
  Synthetic oligonucleotide
ccggattatttcacattctc

SEQ ID NO: 282 - DNA, 20 bp, Artificial sequence
  Synthetic oligonucleotide
ggattctttttccttaggtc

SEQ ID NO: 283 - DNA, 20 bp, Artificial sequence
  Synthetic oligonucleotide
caggacatatcatcatcttc

SEQ ID NO: 284 - DNA, 20 bp, Artificial sequence
  Synthetic oligonucleotide
attgttattcatcttaaggc

SEQ ID NO: 285 - DNA, 20 bp, Artificial sequence
  Synthetic oligonucleotide
gtcaaatctgcatctctgca

SEQ ID NO: 286 - DNA, 20 bp, Artificial sequence
  Synthetic oligonucleotide
atgtgctcattatatgctat

SEQ ID NO: 287 - DNA, 20 bp, Artificial sequence
  Synthetic oligonucleotide
cccatcgattcttaaagcat

SEQ ID NO: 288 - DNA, 20 bp, Artificial sequence
  Synthetic oligonucleotide
ttgtaatttcaatatacacc

SEQ ID NO: 289 - DNA, 20 bp, Artificial sequence
  Synthetic oligonucleotide
acagtactcacttacatagt

SEQ ID NO: 290 - DNA, 20 bp, Artificial sequence
  Synthetic oligonucleotide
gtctcatcacattttaagca

SEQ ID NO: 291 - DNA, 20 bp, Artificial sequence
  Synthetic oligonucleotide
acatcatattcttactgtta

SEQ ID NO: 292 - DNA, 20 bp, Artificial sequence
  Synthetic oligonucleotide
acggacttttttcttcttgc

SEQ ID NO: 293 - DNA, 20 bp, Artificial sequence
  Synthetic oligonucleotide
ccatactcagaaagccatgt

SEQ ID NO: 294 - DNA, 20 bp, Artificial sequence
  Synthetic oligonucleotide
gaagcagctcatctaaacca

SEQ ID NO: 295 - DNA, 20 bp, Artificial sequence
  Synthetic oligonucleotide
aacaactatttgagacatgc

SEQ ID NO: 296 - DNA, 20 bp, Artificial sequence
  Synthetic oligonucleotide
agcagcatttcatcacaatt

SEQ ID NO: 297 - DNA, 20 bp, Artificial sequence
  Synthetic oligonucleotide
gcaccagaccttctcacttc

SEQ ID NO: 298 - DNA, 20 bp, Artificial sequence
  Synthetic oligonucleotide
gcctttaaatacatgctata

SEQ ID NO: 299 - DNA, 20 bp, Artificial sequence
  Synthetic oligonucleotide
ccgtactttgccattcattt

SEQ ID NO: 300 - DNA, 20 bp, Artificial sequence
  Synthetic oligonucleotide
aacccatattatctatggac

SEQ ID NO: 301 - DNA, 20 bp, Artificial sequence
  Synthetic oligonucleotide
gctaaattctttacagtaca

SEQ ID NO: 302 - DNA, 20 bp, Artificial sequence
  Synthetic oligonucleotide
aaatactgctcctatagggt

SEQ ID NO: 303 - DNA, 20 bp, Artificial sequence
  Synthetic oligonucleotide
atcttcactcaattcgatcc

SEQ ID NO: 304 - DNA, 20 bp, Artificial sequence
  Synthetic oligonucleotide
caacactaacccaacttcta

SEQ ID NO: 305 - DNA, 20 bp, Artificial sequence
  Synthetic oligonucleotide
ccaatcattgtcaattacat

SEQ ID NO: 306 - DNA, 20 bp, Artificial sequence
  Synthetic oligonucleotide
ttctcataatttttgctgga

SEQ ID NO: 307 - DNA, 20 bp, Artificial sequence
  Synthetic oligonucleotide
tcccacttaatttttcatcc

SEQ ID NO: 308 - DNA, 20 bp, Artificial sequence
  Synthetic oligonucleotide
gctgttttcacataccatac

SEQ ID NO: 309 - DNA, 20 bp, Artificial sequence
  Synthetic oligonucleotide
ttgaactctttttctccaat

SEQ ID NO: 310 - DNA, 20 bp, Artificial sequence
  Synthetic oligonucleotide
caacctattaccatctggcc

SEQ ID NO: 311 - DNA, 20 bp, Artificial sequence
  Synthetic oligonucleotide
aggttattcaaatatcacca

SEQ ID NO: 312 - DNA, 20 bp, Artificial sequence
  Synthetic oligonucleotide
aacaacaaatgccatcagtc

SEQ ID NO: 313 - DNA, 20 bp, Artificial sequence
  Synthetic oligonucleotide
tagtacattccactttgttt

SEQ ID NO: 314 - DNA, 20 bp, Artificial sequence
  Synthetic oligonucleotide
cacttcccgtcattccatct

SEQ ID NO: 315 - DNA, 20 bp, Artificial sequence
  Synthetic oligonucleotide
gctagatcagatttctcaac

SEQ ID NO: 316 - DNA, 20 bp, Artificial sequence
  Synthetic oligonucleotide
cccttctactcttgtttcca

SEQ ID NO: 317 - DNA, 20 bp, Artificial sequence
  Synthetic oligonucleotide
ggagcttttccattacattc

SEQ ID NO: 318 - DNA, 20 bp, Artificial sequence
  Synthetic oligonucleotide
tcatattgtcttcaatgtgc

SEQ ID NO: 319 - DNA, 20 bp, Artificial sequence
  Synthetic oligonucleotide
tctagtttttcaacagttga

SEQ ID NO: 320 - DNA, 20 bp, Artificial sequence
  Synthetic oligonucleotide
gacatacttctttagcatat

SEQ ID NO: 321 - DNA, 20 bp, Artificial sequence
  Synthetic oligonucleotide
cgttcatcatcatttaacca

SEQ ID NO: 322 - DNA, 20 bp, Artificial sequence
  Synthetic oligonucleotide
atgaacttcatatcctgagt

SEQ ID NO: 323 - DNA, 20 bp, Artificial sequence
  Synthetic oligonucleotide
ttgaacccacatcttctgca

SEQ ID NO: 324 - DNA, 20 bp, Artificial sequence
  Synthetic oligonucleotide
tttcactttgtcatcctccc

SEQ ID NO: 325 - DNA, 20 bp, Artificial sequence
  Synthetic oligonucleotide
tccatcactgtctatatctc

SEQ ID NO: 326 - DNA, 20 bp, Artificial sequence
  Synthetic oligonucleotide
caccatattacttatgcacc

SEQ ID NO: 327 - DNA, 20 bp, Artificial sequence
  Synthetic oligonucleotide
tgattctgtacaatcatcct

SEQ ID NO: 328 - DNA, 20 bp, Artificial sequence
  Synthetic oligonucleotide
ggttactgaactttctaact

SEQ ID NO: 329 - DNA, 20 bp, Artificial sequence
  Synthetic oligonucleotide
tcagaattcacttgacatgc

SEQ ID NO: 330 - DNA, 20 bp, Artificial sequence
  Synthetic oligonucleotide
aggtcattaactttactatc

SEQ ID NO: 331 - DNA, 20 bp, Artificial sequence
  Synthetic oligonucleotide
tgcaactgttcatctcacct

SEQ ID NO: 332 - DNA, 20 bp, Artificial sequence
  Synthetic oligonucleotide
gctacaattatccacatggc

SEQ ID NO: 333 - DNA, 20 bp, Artificial sequence
  Synthetic oligonucleotide
gtgtattttcccatactgta

SEQ ID NO: 334 - DNA, 20 bp, Artificial sequence
  Synthetic oligonucleotide
gcagtcaatcaactccaact

SEQ ID NO: 335 - DNA, 20 bp, Artificial sequence
  Synthetic oligonucleotide
ttgccaattttcagcctaca

SEQ ID NO: 336 - DNA, 20 bp, Artificial sequence
  Synthetic oligonucleotide
gcaccatctataataccatc

SEQ ID NO: 337 - DNA, 20 bp, Artificial sequence
  Synthetic oligonucleotide
gtagtttaattcaccatcac

SEQ ID NO: 338 - DNA, 20 bp, Artificial sequence
  Synthetic oligonucleotide
ttgtactgaactgactccaa

SEQ ID NO: 339 - DNA, 20 bp, Artificial sequence
  Synthetic oligonucleotide
cacatcatggttcatactcc

SEQ ID NO: 340 - DNA, 20 bp, Artificial sequence
  Synthetic oligonucleotide
aggtctctatattttggtcc

SEQ ID NO: 341 - DNA, 20 bp, Artificial sequence
  Synthetic oligonucleotide
gcttcattaccacttctgat

SEQ ID NO: 342 - DNA, 20 bp, Artificial sequence
  Synthetic oligonucleotide
aagagctttttctatctcct

SEQ ID NO: 343 - DNA, 20 bp, Artificial sequence
  Synthetic oligonucleotide
tccggattatttcacattct

SEQ ID NO: 344 - DNA, 20 bp, Artificial sequence
  Synthetic oligonucleotide
gtgctcatttcacatcagac

SEQ ID NO: 345 - DNA, 20 bp, Artificial sequence
  Synthetic oligonucleotide
agctaaattctttacagtac

SEQ ID NO: 346 - DNA, 20 bp, Artificial sequence
  Synthetic oligonucleotide
gtctgcttttcttcttatac

SEQ ID NO: 347 - DNA, 20 bp, Artificial sequence
  Synthetic oligonucleotide
cgtaactgatccttggttca

SEQ ID NO: 348 - DNA, 20 bp, Artificial sequence
  Synthetic oligonucleotide
aacccagaacctgtattaca

SEQ ID NO: 349 - DNA, 20 bp, Artificial sequence
  Synthetic oligonucleotide
gctgcctttaaatacatgct

SEQ ID NO: 350 - DNA, 20 bp, Artificial sequence
  Synthetic oligonucleotide
atgccatttactacactgaa

SEQ ID NO: 351 - DNA, 20 bp, Artificial sequence
  Synthetic oligonucleotide
agcatcttttactatctgcc

SEQ ID NO: 352 - DNA, 20 bp, Artificial sequence
  Synthetic oligonucleotide
ctgtatcttgtcattcctta

SEQ ID NO: 353 - DNA, 20 bp, Artificial sequence
  Synthetic oligonucleotide
tggttatttacctctacggc

SEQ ID NO: 354 - DNA, 20 bp, Artificial sequence
  Synthetic oligonucleotide
gcatcatttttatatgagat

SEQ ID NO: 355 - DNA, 20 bp, Artificial sequence
  Synthetic oligonucleotide
tccagatattactttcttca

SEQ ID NO: 356 - DNA, 20 bp, Artificial sequence
  Synthetic oligonucleotide
gaagcatattcctctatcct

SEQ ID NO: 357 - DNA, 20 bp, Artificial sequence
  Synthetic oligonucleotide
gtggtaactatttctgggca

SEQ ID NO: 358 - DNA, 20 bp, Artificial sequence
  Synthetic oligonucleotide
taccaacttcatcctgaatc

SEQ ID NO: 359 - DNA, 20 bp, Artificial sequence
  Synthetic oligonucleotide
ttggatttatcaatcttcaa

SEQ ID NO: 360 - DNA, 20 bp, Artificial sequence
  Synthetic oligonucleotide
acttctactactttgtcttc

SEQ ID NO: 361 - DNA, 20 bp, Artificial sequence
  Synthetic oligonucleotide
gcattcacaacacacatcct

SEQ ID NO: 362 - DNA, 20 bp, Artificial sequence
  Synthetic oligonucleotide
tgcaactcttctttcaaggt

SEQ ID NO: 363 - DNA, 20 bp, Artificial sequence
  Synthetic oligonucleotide
cactttcttgcactctccaa

SEQ ID NO: 364 - DNA, 20 bp, Artificial sequence
  Synthetic oligonucleotide
accacaacttgacccaggcc

SEQ ID NO: 365 - DNA, 20 bp, Artificial sequence
  Synthetic oligonucleotide
gtgacttatactcaatgaca

SEQ ID NO: 366 - DNA, 20 bp, Artificial sequence
  Synthetic oligonucleotide
tcacagtactcacttacata

SEQ ID NO: 367 - DNA, 20 bp, Artificial sequence
  Synthetic oligonucleotide
gtactcatttttgttcttac

SEQ ID NO: 368 - DNA, 20 bp, Artificial sequence
  Synthetic oligonucleotide
agtcactcataactcatgct

SEQ ID NO: 369 - DNA, 20 bp, Artificial sequence
  Synthetic oligonucleotide
tgcaacttttcaagcaagga

SEQ ID NO: 370 - DNA, 20 bp, Artificial sequence
  Synthetic oligonucleotide
gcttttttaattcttcaatc

SEQ ID NO: 371 - DNA, 20 bp, Artificial sequence
  Synthetic oligonucleotide
cctttgtttgaacccacatc

SEQ ID NO: 372 - DNA, 20 bp, Artificial sequence
  Synthetic oligonucleotide
tcaacactaacccaacttct

SEQ ID NO: 373 - DNA, 20 bp, Artificial sequence
  Synthetic oligonucleotide
ccaccttacctcccatctgc

SEQ ID NO: 374 - DNA, 20 bp, Artificial sequence
  Synthetic oligonucleotide
aacagcttacttaccaactt

SEQ ID NO: 375 - DNA, 20 bp, Artificial sequence
  Synthetic oligonucleotide
gcacaactttatttctagac

SEQ ID NO: 376 - DNA, 20 bp, Artificial sequence
  Synthetic oligonucleotide
gtctaatttctcttcaacag

SEQ ID NO: 377 - DNA, 20 bp, Artificial sequence
  Synthetic oligonucleotide
gtccattttgcaattatagc

SEQ ID NO: 378 - DNA, 20 bp, Artificial sequence
  Synthetic oligonucleotide
tagtctatatattttctgca

SEQ ID NO: 379 - DNA, 20 bp, Artificial sequence
  Synthetic oligonucleotide
gcaaacatccatcctctcct

SEQ ID NO: 380 - DNA, 20 bp, Artificial sequence
  Synthetic oligonucleotide
ccaacctattaccatctggc

SEQ ID NO: 381 - DNA, 20 bp, Artificial sequence
  Synthetic oligonucleotide
acacacttgccaatatcctc

SEQ ID NO: 382 - DNA, 20 bp, Artificial sequence
  Synthetic oligonucleotide
tcttaatcttcactcaattc

SEQ ID NO: 383 - DNA, 20 bp, Artificial sequence
  Synthetic oligonucleotide
cagaacattcttgttagcac

SEQ ID NO: 384 - DNA, 20 bp, Artificial sequence
  Synthetic oligonucleotide
cagcagcatttcatcacaat

SEQ ID NO: 385 - DNA, 20 bp, Artificial sequence
  Synthetic oligonucleotide
gtgcataatttattacatga

SEQ ID NO: 386 - DNA, 20 bp, Artificial sequence
  Synthetic oligonucleotide
atccacattgtcactttctt

SEQ ID NO: 387 - DNA, 20 bp, Artificial sequence
  Synthetic oligonucleotide
aagcatcatatatatacttc

SEQ ID NO: 388 - DNA, 20 bp, Artificial sequence
  Synthetic oligonucleotide
gcggacatacttctttagca

SEQ ID NO: 389 - DNA, 20 bp, Artificial sequence
  Synthetic oligonucleotide
cagtactttattctgttcac

SEQ ID NO: 390 - DNA, 20 bp, Artificial sequence
  Synthetic oligonucleotide
gcattagtttctttaatggt

SEQ ID NO: 391 - DNA, 20 bp, Artificial sequence
  Synthetic oligonucleotide
caactctttcaactcttgca

SEQ ID NO: 392 - DNA, 20 bp, Artificial sequence
  Synthetic oligonucleotide
aagtttacctacctccacca

SEQ ID NO: 393 - DNA, 20 bp, Artificial sequence
  Synthetic oligonucleotide
tggctatattctctcttcaa

SEQ ID NO: 394 - DNA, 20 bp, Artificial sequence
  Synthetic oligonucleotide
cataccatactcagaaagcc

SEQ ID NO: 395 - DNA, 20 bp, Artificial sequence
  Synthetic oligonucleotide
tttcttatatccatgatgct

SEQ ID NO: 396 - DNA, 20 bp, Artificial sequence
  Synthetic oligonucleotide
ccacttcccgtcattccatc

SEQ ID NO: 397 - DNA, 20 bp, Artificial sequence
  Synthetic oligonucleotide
ccagtttttatcttgacctc

SEQ ID NO: 398 - DNA, 20 bp, Artificial sequence
  Synthetic oligonucleotide
ggagacatttcaacatggca

SEQ ID NO: 399 - DNA, 20 bp, Artificial sequence
  Synthetic oligonucleotide
tgatgatgaacttcatatcc

SEQ ID NO: 400 - DNA, 20 bp, Artificial sequence
  Synthetic oligonucleotide
ctcaaaaatactgctcctat

SEQ ID NO: 401 - DNA, 20 bp, Artificial sequence
  Synthetic oligonucleotide
tggttaggtcacttctttta

SEQ ID NO: 402 - DNA, 20 bp, Artificial sequence
  Synthetic oligonucleotide
gtagtcatccttcaaagaaa

SEQ ID NO: 403 - DNA, 20 bp, Artificial sequence
  Synthetic oligonucleotide
atgctgttttcacataccat

SEQ ID NO: 404 - DNA, 20 bp, Artificial sequence
  Synthetic oligonucleotide
gtgaacccacttcttgtctt

SEQ ID NO: 405 - DNA, 20 bp, Artificial sequence
  Synthetic oligonucleotide
ccttatattgccacttccat

SEQ ID NO: 406 - DNA, 20 bp, Artificial sequence
  Synthetic oligonucleotide
cactgcacttagttccacca

SEQ ID NO: 407 - DNA, 20 bp, Artificial sequence
  Synthetic oligonucleotide
cgatgcattttttcacaaaa

SEQ ID NO: 408 - DNA, 20 bp, Artificial sequence
  Synthetic oligonucleotide
gtgctaaattcatccttatc

SEQ ID NO: 409 - DNA, 20 bp, Artificial sequence
  Synthetic oligonucleotide
ccttgctattcatttttcaa

SEQ ID NO: 410 - DNA, 20 bp, Artificial sequence
  Synthetic oligonucleotide
gctccaatcattgtcaatta

SEQ ID NO: 411 - DNA, 20 bp, Artificial sequence
  Synthetic oligonucleotide
atcctcttaattcctatatc

SEQ ID NO: 412 - DNA, 20 bp, Artificial sequence
  Synthetic oligonucleotide
tcggaacttgtcaattccgc

SEQ ID NO: 413 - DNA, 20 bp, Artificial sequence
  Synthetic oligonucleotide
acggactcacacttgctgat

SEQ ID NO: 414 - DNA, 20 bp, Artificial sequence
  Synthetic oligonucleotide
gaatgtacttccttatacca

SEQ ID NO: 415 - DNA, 20 bp, Artificial sequence
  Synthetic oligonucleotide
atccacactttcatactcag

SEQ ID NO: 416 - DNA, 20 bp, Artificial sequence
  Synthetic oligonucleotide
tagcacacatcagtttccac

SEQ ID NO: 417 - DNA, 20 bp, Artificial sequence
  Synthetic oligonucleotide
tacaccatattacttatgca

SEQ ID NO: 418 - DNA, 20 bp, Artificial sequence
  Synthetic oligonucleotide
atgagaatcatctatgcgat

SEQ ID NO: 419 - DNA, 20 bp, Artificial sequence
  Synthetic oligonucleotide
tgctaatgtttcaaatgcaa

SEQ ID NO: 420 - DNA, 20 bp, Artificial sequence
  Synthetic oligonucleotide
tccacatttgcttacattct

SEQ ID NO: 421 - DNA, 20 bp, Artificial sequence
  Synthetic oligonucleotide
ataacggactcacacttgct

SEQ ID NO: 422 - DNA, 20 bp, Artificial sequence
  Synthetic oligonucleotide
gacacttttatcttgcacta

SEQ ID NO: 423 - DNA, 20 bp, Artificial sequence
  Synthetic oligonucleotide
gtttcttatatccatgatgc

SEQ ID NO: 424 - DNA, 20 bp, Artificial sequence
  Synthetic oligonucleotide
gtgccaatttcaacagtgga

SEQ ID NO: 425 - DNA, 20 bp, Artificial sequence
  Synthetic oligonucleotide
caggctgaactctccattca

SEQ ID NO: 426 - DNA, 20 bp, Artificial sequence
  Synthetic oligonucleotide
aggtcattatcaatgacttc

SEQ ID NO: 427 - DNA, 20 bp, Artificial sequence
  Synthetic oligonucleotide
ttggacattttaatctgctt

SEQ ID NO: 428 - DNA, 20 bp, Artificial sequence
  Synthetic oligonucleotide
ttgatatttgtcaacccaga

SEQ ID NO: 429 - DNA, 20 bp, Artificial sequence
  Synthetic oligonucleotide
acagaaccaacaagtcctct

SEQ ID NO: 430 - DNA, 20 bp, Artificial sequence
  Synthetic oligonucleotide
agcaattttccactgcaggc

SEQ ID NO: 431 - DNA, 20 bp, Artificial sequence
  Synthetic oligonucleotide
gtcaacactaacccaacttc

SEQ ID NO: 432 - DNA, 20 bp, Artificial sequence
  Synthetic oligonucleotide
cttaccaacttcatcctgaa

SEQ ID NO: 433 - DNA, 20 bp, Artificial sequence
  Synthetic oligonucleotide
actcacacactgtttcaagc

SEQ ID NO: 434 - DNA, 20 bp, Artificial sequence
  Synthetic oligonucleotide
gcttacttcactttcttgca

SEQ ID NO: 435 - DNA, 20 bp, Artificial sequence
  Synthetic oligonucleotide
tctgatattcacttatctga

SEQ ID NO: 436 - DNA, 20 bp, Artificial sequence
  Synthetic oligonucleotide
caagtttacctacctccacc

SEQ ID NO: 437 - DNA, 20 bp, Artificial sequence
  Synthetic oligonucleotide
gctatgacaacaccgcccac

SEQ ID NO: 438 - DNA, 20 bp, Artificial sequence
  Synthetic oligonucleotide
gtgaatcttcttttaccaca

SEQ ID NO: 439 - DNA, 20 bp, Artificial sequence
  Synthetic oligonucleotide
cgcaaacatccatcctctcc

SEQ ID NO: 440 - DNA, 20 bp, Artificial sequence
  Synthetic oligonucleotide
ccaagcttttttactactca

SEQ ID NO: 441 - DNA, 20 bp, Artificial sequence
  Synthetic oligonucleotide
cagctaaattctttacagta

SEQ ID NO: 442 - DNA, 20 bp, Artificial sequence
  Synthetic oligonucleotide
gttgtttgtaccacatgtca

SEQ ID NO: 443 - DNA, 20 bp, Artificial sequence
  Synthetic oligonucleotide
aagtcaatatttcctgctta

SEQ ID NO: 444 - DNA, 20 bp, Artificial sequence
  Synthetic oligonucleotide
gcttgcttttccacaccacc

SEQ ID NO: 445 - DNA, 20 bp, Artificial sequence
  Synthetic oligonucleotide
gcaagacttttctttgctcc

SEQ ID NO: 446 - DNA, 20 bp, Artificial sequence
  Synthetic oligonucleotide
tcctaattctttgataacac

SEQ ID NO: 447 - DNA, 20 bp, Artificial sequence
  Synthetic oligonucleotide
gtattatttcttttacgcct

SEQ ID NO: 448 - DNA, 20 bp, Artificial sequence
  Synthetic oligonucleotide
gcaacacacaaactctaccc

SEQ ID NO: 449 - DNA, 20 bp, Artificial sequence
  Synthetic oligonucleotide
atctgcaactcttctttcaa

SEQ ID NO: 450 - DNA, 20 bp, Artificial sequence
  Synthetic oligonucleotide
ctgtagtcatccttcaaaga

SEQ ID NO: 451 - DNA, 20 bp, Artificial sequence
  Synthetic oligonucleotide
gaacagcttacttaccaact

SEQ ID NO: 452 - DNA, 20 bp, Artificial sequence
  Synthetic oligonucleotide
gtttacctttaacattcctc

SEQ ID NO: 453 - DNA, 20 bp, Artificial sequence
  Synthetic oligonucleotide
tcattctcatccccaggtgt

SEQ ID NO: 454 - DNA, 20 bp, Artificial sequence
  Synthetic oligonucleotide
gtctaattataccattcctc

SEQ ID NO: 455 - DNA, 20 bp, Artificial sequence
  Synthetic oligonucleotide
cacaacatatatgtatctcc

SEQ ID NO: 456 - DNA, 20 bp, Artificial sequence
  Synthetic oligonucleotide
aaaccacttcccgtcattcc

SEQ ID NO: 457 - DNA, 20 bp, Artificial sequence
  Synthetic oligonucleotide
tcagcagaatccacattgtc

SEQ ID NO: 458 - DNA, 20 bp, Artificial sequence
  Synthetic oligonucleotide
gcctacttttctacttagtc

SEQ ID NO: 459 - DNA, 20 bp, Artificial sequence
  Synthetic oligonucleotide
gccagcttttcctttcacat

SEQ ID NO: 460 - DNA, 20 bp, Artificial sequence
  Synthetic oligonucleotide
cacttcatatctgagcattc

SEQ ID NO: 461 - DNA, 20 bp, Artificial sequence
  Synthetic oligonucleotide
gtcagcattttcctagtcat

SEQ ID NO: 462 - DNA, 20 bp, Artificial sequence
  Synthetic oligonucleotide
gccatattgtcattttacac

SEQ ID NO: 463 - DNA, 20 bp, Artificial sequence
  Synthetic oligonucleotide
gttctcctatttctgttctc

SEQ ID NO: 464 - DNA, 20 bp, Artificial sequence
  Synthetic oligonucleotide
gcagcttcacattagattct

SEQ ID NO: 465 - DNA, 20 bp, Artificial sequence
  Synthetic oligonucleotide
actccatttcatattcatac

SEQ ID NO: 466 - DNA, 20 bp, Artificial sequence
  Synthetic oligonucleotide
caagcagcatcctcctcccc

SEQ ID NO: 467 - DNA, 20 bp, Artificial sequence
  Synthetic oligonucleotide
gtcctatttattcctcatcc

SEQ ID NO: 468 - DNA, 20 bp, Artificial sequence
  Synthetic oligonucleotide
acagtatttctcattcagca

SEQ ID NO: 469 - DNA, 20 bp, Artificial sequence
  Synthetic oligonucleotide
acattcatgctactgcaatc

SEQ ID NO: 470 - DNA, 20 bp, Artificial sequence
  Synthetic oligonucleotide
aatcaattgcattccaaggc

SEQ ID NO: 471 - DNA, 20 bp, Artificial sequence
  Synthetic oligonucleotide
ccagaatgtacttccttata

SEQ ID NO: 472 - DNA, 20 bp, Artificial sequence
  Synthetic oligonucleotide
agatcatatactatacacaa

SEQ ID NO: 473 - DNA, 20 bp, Artificial sequence
  Synthetic oligonucleotide
taggtattctcactggttgc

SEQ ID NO: 474 - DNA, 20 bp, Artificial sequence
  Synthetic oligonucleotide
caaaacttctttctaggcct

SEQ ID NO: 475 - DNA, 20 bp, Artificial sequence
  Synthetic oligonucleotide
ccgtcttaatcttcactcaa

SEQ ID NO: 476 - DNA, 20 bp, Artificial sequence
  Synthetic oligonucleotide
gtacatattcattcaatcta

SEQ ID NO: 477 - DNA, 20 bp, Artificial sequence
  Synthetic oligonucleotide
gcaagcatcatatatatact

SEQ ID NO: 478 - DNA, 20 bp, Artificial sequence
  Synthetic oligonucleotide
cacaaaggccaccttacctc

SEQ ID NO: 479 - DNA, 20 bp, Artificial sequence
  Synthetic oligonucleotide
catcactttactatctgggc

SEQ ID NO: 480 - DNA, 20 bp, Artificial sequence
  Synthetic oligonucleotide
gcactcttatctttcccctc

SEQ ID NO: 481 - DNA, 20 bp, Artificial sequence
  Synthetic oligonucleotide
gcacacatttgcaattctta

SEQ ID NO: 482 - DNA, 20 bp, Artificial sequence
  Synthetic oligonucleotide
gtatcctcttaattcctata

SEQ ID NO: 483 - DNA, 20 bp, Artificial sequence
  Synthetic oligonucleotide
gttccattattccttagcta

SEQ ID NO: 484 - DNA, 20 bp, Artificial sequence
  Synthetic oligonucleotide
ctgtactgccatcctgagca

SEQ ID NO: 485 - DNA, 20 bp, Artificial sequence
  Synthetic oligonucleotide
tccccttatattgccacttc

SEQ ID NO: 486 - DNA, 20 bp, Artificial sequence
  Synthetic oligonucleotide
cgcagattttctcctaaggc

SEQ ID NO: 487 - DNA, 20 bp, Artificial sequence
  Synthetic oligonucleotide
gtcaactttcatgtaaggaa

SEQ ID NO: 488 - DNA, 20 bp, Artificial sequence
  Synthetic oligonucleotide
gctgttcgaatcttcaatct

SEQ ID NO: 489 - DNA, 20 bp, Artificial sequence
  Synthetic oligonucleotide
tcacataccatactcagaaa

SEQ ID NO: 490 - DNA, 20 bp, Artificial sequence
  Synthetic oligonucleotide
cagtgaccacaacttgaccc

SEQ ID NO: 491 - DNA, 20 bp, Artificial sequence
  Synthetic oligonucleotide
ttgtaatattcattgcacta

SEQ ID NO: 492 - DNA, 20 bp, Artificial sequence
  Synthetic oligonucleotide
tttccaacctattaccatct

SEQ ID NO: 493 - DNA, 20 bp, Artificial sequence
  Synthetic oligonucleotide
gcaacacatttatttgatac

SEQ ID NO: 494 - DNA, 20 bp, Artificial sequence
  Synthetic oligonucleotide
gcagtctttcaacttttaat

SEQ ID NO: 495 - DNA, 20 bp, Artificial sequence
  Synthetic oligonucleotide
tcgaaccacctcttccacag

SEQ ID NO: 496 - DNA, 20 bp, Artificial sequence
  Synthetic oligonucleotide
aactcaaaaatactgctcct

SEQ ID NO: 497 - DNA, 20 bp, Artificial sequence
  Synthetic oligonucleotide
tgaatcccacttcccattct

SEQ ID NO: 498 - DNA, 20 bp, Artificial sequence
  Synthetic oligonucleotide
ctctaagcattgtcccagac

SEQ ID NO: 499 - DNA, 20 bp, Artificial sequence
  Synthetic oligonucleotide
cctctatcctttgtcagccc

SEQ ID NO: 500 - DNA, 20 bp, Artificial sequence
  Synthetic oligonucleotide
gctcctgtctttacaacgac

SEQ ID NO: 501 - DNA, 20 bp, Artificial sequence
  Synthetic oligonucleotide
gccaaaccacatattgctct

SEQ ID NO: 502 - DNA, 20 bp, Artificial sequence
  Synthetic oligonucleotide
tgcatagatcttcccattct

SEQ ID NO: 503 - DNA, 20 bp, Artificial sequence
  Synthetic oligonucleotide
ttgttccttcatttagtgga

SEQ ID NO: 504 - DNA, 20 bp, Artificial sequence
  Synthetic oligonucleotide
tggcatatatcatccctaac

SEQ ID NO: 505 - DNA, 20 bp, Artificial sequence
  Synthetic oligonucleotide
cagcatgactccattcttcc

SEQ ID NO: 506 - DNA, 20 bp, Artificial sequence
  Synthetic oligonucleotide
agttttgtccaaatcaggcc

SEQ ID NO: 507 - DNA, 20 bp, Artificial sequence
  Synthetic oligonucleotide
gcctgctctacctctgacca

SEQ ID NO: 508 - DNA, 20 bp, Artificial sequence
  Synthetic oligonucleotide
tagtctgcatattttcacat

SEQ ID NO: 509 - DNA, 20 bp, Artificial sequence
  Synthetic oligonucleotide
ctccatgatcttactcttgc

SEQ ID NO: 510 - DNA, 20 bp, Artificial sequence
  Synthetic oligonucleotide
ctggcatttgaaatcttcca

SEQ ID NO: 511 - DNA, 20 bp, Artificial sequence
  Synthetic oligonucleotide
agtgcatcatattctacact

SEQ ID NO: 512 - DNA, 20 bp, Artificial sequence
  Synthetic oligonucleotide
tcatggccttttcataccca

SEQ ID NO: 513 - DNA, 20 bp, Artificial sequence
  Synthetic oligonucleotide
ccactgctcatctccctcat

SEQ ID NO: 514 - DNA, 20 bp, Artificial sequence
  Synthetic oligonucleotide
tagcagcaataccaacatca

SEQ ID NO: 515 - DNA, 20 bp, Artificial sequence
  Synthetic oligonucleotide
ttcctcacactgctcatcca

SEQ ID NO: 516 - DNA, 20 bp, Artificial sequence
  Synthetic oligonucleotide
agcctttccttatttttgct

SEQ ID NO: 517 - DNA, 20 bp, Artificial sequence
  Synthetic oligonucleotide
tagccatccctcttctgccc

SEQ ID NO: 518 - DNA, 20 bp, Artificial sequence
  Synthetic oligonucleotide
ttgtcatcctccctgcttct

SEQ ID NO: 519 - DNA, 20 bp, Artificial sequence
  Synthetic oligonucleotide
gtctctatattttggtccca

SEQ ID NO: 520 - DNA, 20 bp, Artificial sequence
  Synthetic oligonucleotide
actgcactttttgatgaacc

SEQ ID NO: 521 - DNA, 20 bp, Artificial sequence
  Synthetic oligonucleotide
ctggaaccatcttaatcact

SEQ ID NO: 522 - DNA, 20 bp, Artificial sequence
  Synthetic oligonucleotide
ttggtcatttaatatcaact

SEQ ID NO: 523 - DNA, 20 bp, Artificial sequence
  Synthetic oligonucleotide
tgctccacatcttctgtctt

SEQ ID NO: 524 - DNA, 20 bp, Artificial sequence
  Synthetic oligonucleotide
gctcatctaaaccaaacaaa

SEQ ID NO: 525 - DNA, 20 bp, Artificial sequence
  Synthetic oligonucleotide
ctgctactgacataatacac

SEQ ID NO: 526 - DNA, 20 bp, Artificial sequence
  Synthetic oligonucleotide
aagagcttattaactgcctc

SEQ ID NO: 527 - DNA, 20 bp, Artificial sequence
  Synthetic oligonucleotide
tgtgaatttattcctagagc

SEQ ID NO: 528 - DNA, 20 bp, Artificial sequence
  Synthetic oligonucleotide
gaggcaatctgatattgaca

SEQ ID NO: 529 - DNA, 20 bp, Artificial sequence
  Synthetic oligonucleotide
ggcacagtcttattatgaca

SEQ ID NO: 530 - DNA, 20 bp, Artificial sequence
  Synthetic oligonucleotide
tgagcttcttttctcctaca

SEQ ID NO: 531 - DNA, 20 bp, Artificial sequence
  Synthetic oligonucleotide
gcatctgaacttcttgaggt

SEQ ID NO: 532 - DNA, 20 bp, Artificial sequence
  Synthetic oligonucleotide
gtgcaccctcacaccgacct

SEQ ID NO: 533 - DNA, 20 bp, Artificial sequence
  Synthetic oligonucleotide
aatttgcctcattttctatg

SEQ ID NO: 534 - DNA, 20 bp, Artificial sequence
  Synthetic oligonucleotide
gtgaagctatcttctctcct

SEQ ID NO: 535 - DNA, 20 bp, Artificial sequence
  Synthetic oligonucleotide
taggtcccacacatgcatct

SEQ ID NO: 536 - DNA, 20 bp, Artificial sequence
  Synthetic oligonucleotide
aagcatgctacaacccgggc

SEQ ID NO: 537 - DNA, 20 bp, Artificial sequence
  Synthetic oligonucleotide
gttccatccattatgtgccc

SEQ ID NO: 538 - DNA, 20 bp, Artificial sequence
  Synthetic oligonucleotide
tgccaccctccccaagatca

SEQ ID NO: 539 - DNA, 20 bp, Artificial sequence
  Synthetic oligonucleotide
cagctgccttttcaagtgta

SEQ ID NO: 540 - DNA, 20 bp, Artificial sequence
  Synthetic oligonucleotide
ccacaattcaactagcagca

SEQ ID NO: 541 - DNA, 20 bp, Artificial sequence
  Synthetic oligonucleotide
gtactccatctcctcccatc

SEQ ID NO: 542 - DNA, 20 bp, Artificial sequence
  Synthetic oligonucleotide
ctccaacatccacactcaga

SEQ ID NO: 543 - DNA, 20 bp, Artificial sequence
  Synthetic oligonucleotide
atatcagtttttctctaggt

SEQ ID NO: 544 - DNA, 20 bp, Artificial sequence
  Synthetic oligonucleotide
tcgatccttttatctgcacc

SEQ ID NO: 545 - DNA, 20 bp, Artificial sequence
  Synthetic oligonucleotide
ctccactcaaactctccata

SEQ ID NO: 546 - DNA, 20 bp, Artificial sequence
  Synthetic oligonucleotide
ctcttgttacatacttccca

SEQ ID NO: 547 - DNA, 20 bp, Artificial sequence
  Synthetic oligonucleotide
cagatatttcaatatacagt

SEQ ID NO: 548 - DNA, 20 bp, Artificial sequence
  Synthetic oligonucleotide
gcatgggttacactttggta

SEQ ID NO: 549 - DNA, 20 bp, Artificial sequence
  Synthetic oligonucleotide
ccaccacacagccctcactc

SEQ ID NO: 550 - DNA, 20 bp, Artificial sequence
  Synthetic oligonucleotide
ccaccttccttctatgtaca

SEQ ID NO: 551 - DNA, 20 bp, Artificial sequence
  Synthetic oligonucleotide
cagcactgagaatcaagttc

SEQ ID NO: 552 - DNA, 20 bp, Artificial sequence
  Synthetic oligonucleotide
gacctcttttattttagtca

SEQ ID NO: 553 - DNA, 20 bp, Artificial sequence
  Synthetic oligonucleotide
tttccggattatttcacatt

SEQ ID NO: 554 - DNA, 20 bp, Artificial sequence
  Synthetic oligonucleotide
gctactgaagctctctggtc

SEQ ID NO: 555 - DNA, 20 bp, Artificial sequence
  Synthetic oligonucleotide
gctgggtttctttttctcac

SEQ ID NO: 556 - DNA, 20 bp, Artificial sequence
  Synthetic oligonucleotide
ctgcatagtctgtgtctgct

SEQ ID NO: 557 - DNA, 20 bp, Artificial sequence
  Synthetic oligonucleotide
tgcaaacttcatccctactt

SEQ ID NO: 558 - DNA, 20 bp, Artificial sequence
  Synthetic oligonucleotide
agtgcttcattaccacttct

SEQ ID NO: 559 - DNA, 20 bp, Artificial sequence
  Synthetic oligonucleotide
gcataaaccatagagctctc

SEQ ID NO: 560 - DNA, 20 bp, Artificial sequence
  Synthetic oligonucleotide
aagactttcaaattctagcc

SEQ ID NO: 561 - DNA, 20 bp, Artificial sequence
  Synthetic oligonucleotide
aaccatgaatatcaatgcct

SEQ ID NO: 562 - DNA, 20 bp, Artificial sequence
  Synthetic oligonucleotide
tagactgtcactctcacgcc

SEQ ID NO: 563 - DNA, 20 bp, Artificial sequence
  Synthetic oligonucleotide
gtattgttctctccaggttt

SEQ ID NO: 564 - DNA, 20 bp, Artificial sequence
  Synthetic oligonucleotide
gctaatgcattccttacccc

SEQ ID NO: 565 - DNA, 20 bp, Artificial sequence
  Synthetic oligonucleotide
agcttttccataccagtccc

SEQ ID NO: 566 - DNA, 20 bp, Artificial sequence
  Synthetic oligonucleotide
actcttgtttccatgagttt

SEQ ID NO: 567 - DNA, 20 bp, Artificial sequence
  Synthetic oligonucleotide
gatgtctttcaccactccca

SEQ ID NO: 568 - DNA, 20 bp, Artificial sequence
  Synthetic oligonucleotide
acaaggctactcttcaactt

SEQ ID NO: 569 - DNA, 20 bp, Artificial sequence
  Synthetic oligonucleotide
gctgactctcccatttattt

SEQ ID NO: 570 - DNA, 20 bp, Artificial sequence
  Synthetic oligonucleotide
atgctaaatcagttctcttg

SEQ ID NO: 571 - DNA, 20 bp, Artificial sequence
  Synthetic oligonucleotide
cgccccatgccacatttctc

SEQ ID NO: 572 - DNA, 20 bp, Artificial sequence
  Synthetic oligonucleotide
gccttgtacaaactctctac

SEQ ID NO: 573 - DNA, 20 bp, Artificial sequence
  Synthetic oligonucleotide
ccacatgtcaaaccgtggct

SEQ ID NO: 574 - DNA, 20 bp, Artificial sequence
  Synthetic oligonucleotide
acgctacattccattttcta

SEQ ID NO: 575 - DNA, 20 bp, Artificial sequence
  Synthetic oligonucleotide
cctagtgcatcatattctac

SEQ ID NO: 576 - DNA, 20 bp, Artificial sequence
  Synthetic oligonucleotide
gcttttctgatattcactta

SEQ ID NO: 577 - DNA, 20 bp, Artificial sequence
  Synthetic oligonucleotide
tgcagatatttcaatataca

SEQ ID NO: 578 - DNA, 20 bp, Artificial sequence
  Synthetic oligonucleotide
gttcaatatccttagctcta

SEQ ID NO: 579 - DNA, 20 bp, Artificial sequence
  Synthetic oligonucleotide
catgctaaatcagttctctt

SEQ ID NO: 580 - DNA, 20 bp, Artificial sequence
  Synthetic oligonucleotide
atggctctattccctagtct

SEQ ID NO: 581 - DNA, 20 bp, Artificial sequence
  Synthetic oligonucleotide
gggcacagtcttattatgac

SEQ ID NO: 582 - DNA, 20 bp, Artificial sequence
  Synthetic oligonucleotide
gcttccacttgataacctat

SEQ ID NO: 583 - DNA, 20 bp, Artificial sequence
  Synthetic oligonucleotide
gctcattacccatccttata

SEQ ID NO: 584 - DNA, 20 bp, Artificial sequence
  Synthetic oligonucleotide
gctcactccatgatcttact

SEQ ID NO: 585 - DNA, 20 bp, Artificial sequence
  Synthetic oligonucleotide
ggatgtctttcaccactccc

SEQ ID NO: 586 - DNA, 20 bp, Artificial sequence
  Synthetic oligonucleotide
gcaggtcctatttttgttcc

SEQ ID NO: 587 - DNA, 20 bp, Artificial sequence
  Synthetic oligonucleotide
cctcaggtcccacccagatc

SEQ ID NO: 588 - DNA, 20 bp, Artificial sequence
  Synthetic oligonucleotide
gtagatatacagctccctca

SEQ ID NO: 589 - DNA, 20 bp, Artificial sequence
  Synthetic oligonucleotide
tagcattccttcttctcagc

SEQ ID NO: 590 - DNA, 20 bp, Artificial sequence
  Synthetic oligonucleotide
ggtctctatattttggtccc

SEQ ID NO: 591 - DNA, 20 bp, Artificial sequence
  Synthetic oligonucleotide
gcagctcatctaaaccaaac

SEQ ID NO: 592 - DNA, 20 bp, Artificial sequence
  Synthetic oligonucleotide
tgggactataactctactcc

SEQ ID NO: 593 - DNA, 20 bp, Artificial sequence
  Synthetic oligonucleotide
aggcattcagacttctgtct

SEQ ID NO: 594 - DNA, 20 bp, Artificial sequence
  Synthetic oligonucleotide
tccttcctcacactgctcat

SEQ ID NO: 595 - DNA, 20 bp, Artificial sequence
  Synthetic oligonucleotide
tctgcatagtctgtgtctgc

SEQ ID NO: 596 - DNA, 20 bp, Artificial sequence
  Synthetic oligonucleotide
cagcctttccttatttttgc

SEQ ID NO: 597 - DNA, 20 bp, Artificial sequence
  Synthetic oligonucleotide
aagcatattcctctatcctt

SEQ ID NO: 598 - DNA, 20 bp, Artificial sequence
  Synthetic oligonucleotide
gaatcctctaagcattgtcc

SEQ ID NO: 599 - DNA, 20 bp, Artificial sequence
  Synthetic oligonucleotide
actgtgctcttcaagagctt

SEQ ID NO: 600 - DNA, 20 bp, Artificial sequence
  Synthetic oligonucleotide
gctacctcctattctgctga

SEQ ID NO: 601 - DNA, 20 bp, Artificial sequence
  Synthetic oligonucleotide
tctggctacaattatccaca

SEQ ID NO: 602 - DNA, 20 bp, Artificial sequence
  Synthetic oligonucleotide
gttgctttctcctaacactt

SEQ ID NO: 603 - DNA, 20 bp, Artificial sequence
  Synthetic oligonucleotide
tggcttatgatctatacact

SEQ ID NO: 604 - DNA, 20 bp, Artificial sequence
  Synthetic oligonucleotide
gatcaatgttcctttttgca

SEQ ID NO: 605 - DNA, 20 bp, Artificial sequence
  Synthetic oligonucleotide
gcaactcacaactaatgtct

SEQ ID NO: 606 - DNA, 20 bp, Artificial sequence
  Synthetic oligonucleotide
tggccttcccaattttcacc

SEQ ID NO: 607 - DNA, 20 bp, Artificial sequence
  Synthetic oligonucleotide
gtagccatccctcttctgcc

SEQ ID NO: 608 - DNA, 20 bp, Artificial sequence
  Synthetic oligonucleotide
tgctgactctcccatttatt

SEQ ID NO: 609 - DNA, 20 bp, Artificial sequence
  Synthetic oligonucleotide
atctgctactgacataatac

SEQ ID NO: 610 - DNA, 20 bp, Artificial sequence
  Synthetic oligonucleotide
ctgctccacatcttctgtct

SEQ ID NO: 611 - DNA, 20 bp, Artificial sequence
  Synthetic oligonucleotide
atgactccaacatccacact

SEQ ID NO: 612 - DNA, 20 bp, Artificial sequence
  Synthetic oligonucleotide
tccacaattcaactagcagc

SEQ ID NO: 613 - DNA, 20 bp, Artificial sequence
  Synthetic oligonucleotide
aagttttgtccaaatcaggc

SEQ ID NO: 614 - DNA, 20 bp, Artificial sequence
  Synthetic oligonucleotide
cacccttctactcttgtttc

SEQ ID NO: 615 - DNA, 20 bp, Artificial sequence
  Synthetic oligonucleotide
tggttgtacccctaagaatc

SEQ ID NO: 616 - DNA, 20 bp, Artificial sequence
  Synthetic oligonucleotide
tggtcattccttatgagacc

SEQ ID NO: 617 - DNA, 20 bp, Artificial sequence
  Synthetic oligonucleotide
ttgcaaacttcatccctact

SEQ ID NO: 618 - DNA, 20 bp, Artificial sequence
  Synthetic oligonucleotide
tctcttgttacatacttccc

SEQ ID NO: 619 - DNA, 20 bp, Artificial sequence
  Synthetic oligonucleotide
ttgggacaatatcatgccaa

SEQ ID NO: 620 - DNA, 20 bp, Artificial sequence
  Synthetic oligonucleotide
gccactgctcatctccctca

SEQ ID NO: 621 - DNA, 20 bp, Artificial sequence
  Synthetic oligonucleotide
gcacatttacatgctccctt

SEQ ID NO: 622 - DNA, 20 bp, Artificial sequence
  Synthetic oligonucleotide
tctacagttaatatttgccc

SEQ ID NO: 623 - DNA, 20 bp, Artificial sequence
  Synthetic oligonucleotide
gcttctggaaccatcttaat

SEQ ID NO: 624 - DNA, 20 bp, Artificial sequence
  Synthetic oligonucleotide
agccaagttcatatcaaact

SEQ ID NO: 625 - DNA, 20 bp, Artificial sequence
  Synthetic oligonucleotide
gctctcaactttgatgttca

SEQ ID NO: 626 - DNA, 20 bp, Artificial sequence
  Synthetic oligonucleotide
aagcttccatattaggacca

SEQ ID NO: 627 - DNA, 20 bp, Artificial sequence
  Synthetic oligonucleotide
tctgcaggcctcaatctgct

SEQ ID NO: 628 - DNA, 20 bp, Artificial sequence
  Synthetic oligonucleotide
tgtgcctcttcttccagcaa

SEQ ID NO: 629 - DNA, 20 bp, Artificial sequence
  Synthetic oligonucleotide
tcattggttttaatcagttc

SEQ ID NO: 630 - DNA, 20 bp, Artificial sequence
  Synthetic oligonucleotide
cacagcgatcaaaccgcccc

SEQ ID NO: 631 - DNA, 20 bp, Artificial sequence
  Synthetic oligonucleotide
gcacatcacaacaattctcc

SEQ ID NO: 632 - DNA, 20 bp, Artificial sequence
  Synthetic oligonucleotide
tgatgcacatatccaggctt

SEQ ID NO: 633 - DNA, 20 bp, Artificial sequence
  Synthetic oligonucleotide
gtgacacaacatcagaggca

SEQ ID NO: 634 - DNA, 20 bp, Artificial sequence
  Synthetic oligonucleotide
gtttccggattatttcacat

SEQ ID NO: 635 - DNA, 20 bp, Artificial sequence
  Synthetic oligonucleotide
gcatcacaattcttcattgc

SEQ ID NO: 636 - DNA, 20 bp, Artificial sequence
  Synthetic oligonucleotide
gaacaaggctactcttcaac

SEQ ID NO: 637 - DNA, 20 bp, Artificial sequence
  Synthetic oligonucleotide
gcctttacactgtattgttc

SEQ ID NO: 638 - DNA, 20 bp, Artificial sequence
  Synthetic oligonucleotide
cccaccttccttctatgtac

SEQ ID NO: 639 - DNA, 20 bp, Artificial sequence
  Synthetic oligonucleotide
gcagacccaatatattagga

SEQ ID NO: 640 - DNA, 20 bp, Artificial sequence
  Synthetic oligonucleotide
agtactccatctcctcccat

SEQ ID NO: 641 - DNA, 20 bp, Artificial sequence
  Synthetic oligonucleotide
accaccacacagccctcact

SEQ ID NO: 642 - DNA, 20 bp, Artificial sequence
  Synthetic oligonucleotide
gtttctgtaacatttggtca

SEQ ID NO: 643 - DNA, 20 bp, Artificial sequence
  Synthetic oligonucleotide
gctgcttattttcatctaat

SEQ ID NO: 644 - DNA, 20 bp, Artificial sequence
  Synthetic oligonucleotide
ctcaacctataccactatcc

SEQ ID NO: 645 - DNA, 20 bp, Artificial sequence
  Synthetic oligonucleotide
tgtcaattttccctttcatc

SEQ ID NO: 646 - DNA, 20 bp, Artificial sequence
  Synthetic oligonucleotide
caccatgcagattatcagct

SEQ ID NO: 647 - DNA, 20 bp, Artificial sequence
  Synthetic oligonucleotide
tctcatactctgcccatcaa

SEQ ID NO: 648 - DNA, 20 bp, Artificial sequence
  Synthetic oligonucleotide
aaagactttcaaattctagc

SEQ ID NO: 649 - DNA, 20 bp, Artificial sequence
  Synthetic oligonucleotide
ctgcagcctccacacagctt

SEQ ID NO: 650 - DNA, 20 bp, Artificial sequence
  Synthetic oligonucleotide
tgccttgtacaaactctcta

SEQ ID NO: 651 - DNA, 20 bp, Artificial sequence
  Synthetic oligonucleotide
gcacttagttccaccatcat

SEQ ID NO: 652 - DNA, 20 bp, Artificial sequence
  Synthetic oligonucleotide
tgcacatcacaacaattctc

SEQ ID NO: 653 - DNA, 20 bp, Artificial sequence
  Synthetic oligonucleotide
atgtctctttggcgacggtg

SEQ ID NO: 654 - DNA, 20 bp, Artificial sequence
  Synthetic oligonucleotide
gttcatctcatactctgccc

SEQ ID NO: 655 - DNA, 20 bp, Artificial sequence
  Synthetic oligonucleotide
gctgccttgtacaaactctc

SEQ ID NO: 656 - DNA, 20 bp, Artificial sequence
  Synthetic oligonucleotide
gctgctgtcttctttgcaca

SEQ ID NO: 657 - DNA, 20 bp, Artificial sequence
  Synthetic oligonucleotide
gcactcataactagggttcc

SEQ ID NO: 658 - DNA, 20 bp, Artificial sequence
  Synthetic oligonucleotide
cctcctttttattctgtcta

SEQ ID NO: 659 - DNA, 20 bp, Artificial sequence
  Synthetic oligonucleotide
cctgaccacttgctacctcc

SEQ ID NO: 660 - DNA, 20 bp, Artificial sequence
  Synthetic oligonucleotide
ttccttcctcacactgctca

SEQ ID NO: 661 - DNA, 20 bp, Artificial sequence
  Synthetic oligonucleotide
gcacatgttttctttgtaac

SEQ ID NO: 662 - DNA, 20 bp, Artificial sequence
  Synthetic oligonucleotide
acccaccttccttctatgta

SEQ ID NO: 663 - DNA, 20 bp, Artificial sequence
  Synthetic oligonucleotide
ttgatgcacatatccaggct

SEQ ID NO: 664 - DNA, 20 bp, Artificial sequence
  Synthetic oligonucleotide
atgcatactctttaaggaac

SEQ ID NO: 665 - DNA, 20 bp, Artificial sequence
  Synthetic oligonucleotide
gctaggacagattagcaccc

SEQ ID NO: 666 - DNA, 20 bp, Artificial sequence
  Synthetic oligonucleotide
atctgcatagtctgtgtctg

SEQ ID NO: 667 - DNA, 20 bp, Artificial sequence
  Synthetic oligonucleotide
aacctgtcttaactagccct

SEQ ID NO: 668 - DNA, 20 bp, Artificial sequence
  Synthetic oligonucleotide
ggtatctgtctacacctgct

SEQ ID NO: 669 - DNA, 20 bp, Artificial sequence
  Synthetic oligonucleotide
tgtgactcagatccaaggtc

SEQ ID NO: 670 - DNA, 20 bp, Artificial sequence
  Synthetic oligonucleotide
agcatgctaaatcagttctc

SEQ ID NO: 671 - DNA, 20 bp, Artificial sequence
  Synthetic oligonucleotide
agggcatcacaattcttcat

SEQ ID NO: 672 - DNA, 20 bp, Artificial sequence
  Synthetic oligonucleotide
ctgcagtcttactcttggat

SEQ ID NO: 673 - DNA, 20 bp, Artificial sequence
  Synthetic oligonucleotide
tgtctcttctgcaacttact

SEQ ID NO: 674 - DNA, 20 bp, Artificial sequence
  Synthetic oligonucleotide
gggttagtactccatctcct

SEQ ID NO: 675 - DNA, 20 bp, Artificial sequence
  Synthetic oligonucleotide
cccttcgctttgaatccttt

SEQ ID NO: 676 - DNA, 20 bp, Artificial sequence
  Synthetic oligonucleotide
atgcacgacttctataactt

SEQ ID NO: 677 - DNA, 20 bp, Artificial sequence
  Synthetic oligonucleotide
ggtttccggattatttcaca

SEQ ID NO: 678 - DNA, 20 bp, Artificial sequence
  Synthetic oligonucleotide
agttgctgatatacttggac

SEQ ID NO: 679 - DNA, 20 bp, Artificial sequence
  Synthetic oligonucleotide
acagtttcttgatttttccc

SEQ ID NO: 680 - DNA, 20 bp, Artificial sequence
  Synthetic oligonucleotide
catcacatcttttaatgctt

SEQ ID NO: 681 - DNA, 20 bp, Artificial sequence
  Synthetic oligonucleotide
tgctcattacccatccttat

SEQ ID NO: 682 - DNA, 20 bp, Artificial sequence
  Synthetic oligonucleotide
gagctctttcctcactggga

SEQ ID NO: 683 - DNA, 20 bp, Artificial sequence
  Synthetic oligonucleotide
tccaatgttctcattgccca

SEQ ID NO: 684 - DNA, 20 bp, Artificial sequence
  Synthetic oligonucleotide
ccacccttctactcttgttt

SEQ ID NO: 685 - DNA, 20 bp, Artificial sequence
  Synthetic oligonucleotide
tcctatcctatctctctggc

SEQ ID NO: 686 - DNA, 20 bp, Artificial sequence
  Synthetic oligonucleotide
atttcttacactttcaagat

SEQ ID NO: 687 - DNA, 20 bp, Artificial sequence
  Synthetic oligonucleotide
gctgttctattaacttccat

SEQ ID NO: 688 - DNA, 20 bp, Artificial sequence
  Synthetic oligonucleotide
atctgattttgaaaccagtc

SEQ ID NO: 689 - DNA, 20 bp, Artificial sequence
  Synthetic oligonucleotide
gtatcttcatttaatcactt

SEQ ID NO: 690 - DNA, 20 bp, Artificial sequence
  Synthetic oligonucleotide
gagcacatttacatgctccc

SEQ ID NO: 691 - DNA, 20 bp, Artificial sequence
  Synthetic oligonucleotide
ctggactctcaccatgcaga

SEQ ID NO: 692 - DNA, 20 bp, Artificial sequence
  Synthetic oligonucleotide
cctccacaattcaactagca

SEQ ID NO: 693 - DNA, 20 bp, Artificial sequence
  Synthetic oligonucleotide
gtgcagatatttcaatatac

SEQ ID NO: 694 - DNA, 20 bp, Artificial sequence
  Synthetic oligonucleotide
tcatattcttcatctggcta

SEQ ID NO: 695 - DNA, 20 bp, Artificial sequence
  Synthetic oligonucleotide
actctattcatcctacccca

SEQ ID NO: 696 - DNA, 20 bp, Artificial sequence
  Synthetic oligonucleotide
cctcacagcctttacactgt

SEQ ID NO: 697 - DNA, 20 bp, Artificial sequence
  Synthetic oligonucleotide
ttgttatcaagatttcaccc

SEQ ID NO: 698 - DNA, 20 bp, Artificial sequence
  Synthetic oligonucleotide
tcctagtgcatcatattcta

SEQ ID NO: 699 - DNA, 20 bp, Artificial sequence
  Synthetic oligonucleotide
tttgaactactagatcagcc

SEQ ID NO: 700 - DNA, 20 bp, Artificial sequence
  Synthetic oligonucleotide
gcacagcgatcaaaccgccc

SEQ ID NO: 701 - DNA, 20 bp, Artificial sequence
  Synthetic oligonucleotide
tgctgcttattttcatctaa

SEQ ID NO: 702 - DNA, 20 bp, Artificial sequence
  Synthetic oligonucleotide
ccactagtatctcttgttac

SEQ ID NO: 703 - DNA, 20 bp, Artificial sequence
  Synthetic oligonucleotide
ggtgattcagtctctgtcct

SEQ ID NO: 704 - DNA, 20 bp, Artificial sequence
  Synthetic oligonucleotide
gctttcaaatatccttggcc

SEQ ID NO: 705 - DNA, 20 bp, Artificial sequence
  Synthetic oligonucleotide
ccatgaatcctctaagcatt

SEQ ID NO: 706 - DNA, 20 bp, Artificial sequence
  Synthetic oligonucleotide
ccagcctatttctctcctaa

SEQ ID NO: 707 - DNA, 20 bp, Artificial sequence
  Synthetic oligonucleotide
ttgtgcctcttcttccagca

SEQ ID NO: 708 - DNA, 20 bp, Artificial sequence
  Synthetic oligonucleotide
gcagaatatccttcatagtc

SEQ ID NO: 709 - DNA, 20 bp, Artificial sequence
  Synthetic oligonucleotide
gtctctgactttttccgatt

SEQ ID NO: 710 - DNA, 20 bp, Artificial sequence
  Synthetic oligonucleotide
ctgcacttagttccaccatc

SEQ ID NO: 711 - DNA, 20 bp, Artificial sequence
  Synthetic oligonucleotide
aaggtctctatattttggtc

SEQ ID NO: 712 - DNA, 20 bp, Artificial sequence
  Synthetic oligonucleotide
ctccactcctgcttctggaa

SEQ ID NO: 713 - DNA, 20 bp, Artificial sequence
  Synthetic oligonucleotide
acttgtcaacggcatcaggg

SEQ ID NO: 714 - DNA, 20 bp, Artificial sequence
  Synthetic oligonucleotide
ctggtcattccttatgagac

SEQ ID NO: 715 - DNA, 20 bp, Artificial sequence
  Synthetic oligonucleotide
gctgctccacatcttctgtc

SEQ ID NO: 716 - DNA, 20 bp, Artificial sequence
  Synthetic oligonucleotide
cttttcaagcaaggaaaaac

SEQ ID NO: 717 - DNA, 20 bp, Artificial sequence
  Synthetic oligonucleotide
tctcaatagatacttatcgc

SEQ ID NO: 718 - DNA, 20 bp, Artificial sequence
  Synthetic oligonucleotide
gctcactcatgccttctgca

SEQ ID NO: 719 - DNA, 20 bp, Artificial sequence
  Synthetic oligonucleotide
gcaccaccacacagccctca

SEQ ID NO: 720 - DNA, 20 bp, Artificial sequence
  Synthetic oligonucleotide
cacagctttgtaacctgctc

SEQ ID NO: 721 - DNA, 20 bp, Artificial sequence
  Synthetic oligonucleotide
cagcaaggccactctccata

SEQ ID NO: 722 - DNA, 20 bp, Artificial sequence
  Synthetic oligonucleotide
ctagcaccatttcctcatcc

SEQ ID NO: 723 - DNA, 20 bp, Artificial sequence
  Synthetic oligonucleotide
ccttgggacaatatcatgcc

SEQ ID NO: 724 - DNA, 20 bp, Artificial sequence
  Synthetic oligonucleotide
tggttgctttctcctaacac

SEQ ID NO: 725 - DNA, 20 bp, Artificial sequence
  Synthetic oligonucleotide
ctgtagtgctgactctccca

SEQ ID NO: 726 - DNA, 20 bp, Artificial sequence
  Synthetic oligonucleotide
gctgtgaacttccactgctt

SEQ ID NO: 727 - DNA, 20 bp, Artificial sequence
  Synthetic oligonucleotide
aagcagctcatctaaaccaa

SEQ ID NO: 728 - DNA, 20 bp, Artificial sequence
  Synthetic oligonucleotide
gttgctttacctctaaggtc

SEQ ID NO: 729 - DNA, 20 bp, Artificial sequence
  Synthetic oligonucleotide
gccatctcatttagttgtct

SEQ ID NO: 730 - DNA, 20 bp, Artificial sequence
  Synthetic oligonucleotide
cccttctaccaacacttcgc

SEQ ID NO: 731 - DNA, 20 bp, Artificial sequence
  Synthetic oligonucleotide
ccatctgcatagtctgtgtc

SEQ ID NO: 732 - DNA, 20 bp, Artificial sequence
  Synthetic oligonucleotide
gtttcatacactcaaggctt

SEQ ID NO: 733 - DNA, 20 bp, Artificial sequence
  Synthetic oligonucleotide
aacttttcaagcaaggaaaa

SEQ ID NO: 734 - DNA, 20 bp, Artificial sequence
  Synthetic oligonucleotide
acgcaaatccctgccagtgt

SEQ ID NO: 735 - DNA, 20 bp, Artificial sequence
  Synthetic oligonucleotide
gtctcctctgtcaacacaac

SEQ ID NO: 736 - DNA, 20 bp, Artificial sequence
  Synthetic oligonucleotide
ccattagccttgctattcat

SEQ ID NO: 737 - DNA, 20 bp, Artificial sequence
  Synthetic oligonucleotide
tggtaactatttctgggcaa

SEQ ID NO: 738 - DNA, 20 bp, Artificial sequence
  Synthetic oligonucleotide
gtggtctcagcatcctgttc

SEQ ID NO: 739 - DNA, 20 bp, Artificial sequence
  Synthetic oligonucleotide
agcctgctcactcatgcctt

SEQ ID NO: 740 - DNA, 20 bp, Artificial sequence
  Synthetic oligonucleotide
tacttgtcaacggcatcagg

SEQ ID NO: 741 - DNA, 20 bp, Artificial sequence
  Synthetic oligonucleotide
tccagcctatttctctccta

SEQ ID NO: 742 - DNA, 20 bp, Artificial sequence
  Synthetic oligonucleotide
gcacttgattccatttcctc

SEQ ID NO: 743 - DNA, 20 bp, Artificial sequence
  Synthetic oligonucleotide
tgctaagatctcattctaga

SEQ ID NO: 744 - DNA, 20 bp, Artificial sequence
  Synthetic oligonucleotide
cccaacttaattttttccaa

SEQ ID NO: 745 - DNA, 20 bp, Artificial sequence
  Synthetic oligonucleotide
gttgaccattcaaaggtccc

SEQ ID NO: 746 - DNA, 20 bp, Artificial sequence
  Synthetic oligonucleotide
tcccatctaaattttgcttt

SEQ ID NO: 747 - DNA, 20 bp, Artificial sequence
  Synthetic oligonucleotide
atgcttttttcacaacagca

SEQ ID NO: 748 - DNA, 20 bp, Artificial sequence
  Synthetic oligonucleotide
acaggttttccccacatctt

SEQ ID NO: 749 - DNA, 20 bp, Artificial sequence
  Synthetic oligonucleotide
acaccatcacaacagaaccc

SEQ ID NO: 750 - DNA, 20 bp, Artificial sequence
  Synthetic oligonucleotide
tcaccaactcttctttagca

SEQ ID NO: 751 - DNA, 20 bp, Artificial sequence
  Synthetic oligonucleotide
ctgttcatctcatactctgc

SEQ ID NO: 752 - DNA, 20 bp, Artificial sequence
  Synthetic oligonucleotide
gcctcctacttcctatccta

SEQ ID NO: 753 - DNA, 20 bp, Artificial sequence
  Synthetic oligonucleotide
gcttgtttgaactactagat

SEQ ID NO: 754 - DNA, 20 bp, Artificial sequence
  Synthetic oligonucleotide
tgctgctccacatcttctgt

SEQ ID NO: 755 - DNA, 20 bp, Artificial sequence
  Synthetic oligonucleotide
tctccattcaaatccacagc

SEQ ID NO: 756 - DNA, 20 bp, Artificial sequence
  Synthetic oligonucleotide
tgggtaaataattacccacc

SEQ ID NO: 757 - DNA, 20 bp, Artificial sequence
  Synthetic oligonucleotide
ggtagttatctctatccctc

SEQ ID NO: 758 - DNA, 20 bp, Artificial sequence
  Synthetic oligonucleotide
gaaccctccactcctgcttc

SEQ ID NO: 759 - DNA, 20 bp, Artificial sequence
  Synthetic oligonucleotide
ggtgacactcaaatctgtgt

SEQ ID NO: 760 - DNA, 20 bp, Artificial sequence
  Synthetic oligonucleotide
ccgttcctttccaccctgct

SEQ ID NO: 761 - DNA, 20 bp, Artificial sequence
  Synthetic oligonucleotide
actgcagtcttactcttgga

SEQ ID NO: 762 - DNA, 20 bp, Artificial sequence
  Synthetic oligonucleotide
ttccaatgttctcattgccc

SEQ ID NO: 763 - DNA, 20 bp, Artificial sequence
  Synthetic oligonucleotide
gaggtcataaaaatcatgct

SEQ ID NO: 764 - DNA, 20 bp, Artificial sequence
  Synthetic oligonucleotide
cctgggttagtactccatct

SEQ ID NO: 765 - DNA, 20 bp, Artificial sequence
  Synthetic oligonucleotide
caccacaacttttatcatct

SEQ ID NO: 766 - DNA, 20 bp, Artificial sequence
  Synthetic oligonucleotide
ggcgacattcctccagtctt

SEQ ID NO: 767 - DNA, 20 bp, Artificial sequence
  Synthetic oligonucleotide
gttcactaatcatgttggcc

SEQ ID NO: 768 - DNA, 20 bp, Artificial sequence
  Synthetic oligonucleotide
accagaccttctcacttcga

SEQ ID NO: 769 - DNA, 20 bp, Artificial sequence
  Synthetic oligonucleotide
agtgcagatatttcaatata

SEQ ID NO: 770 - DNA, 20 bp, Artificial sequence
  Synthetic oligonucleotide
agagcacatttacatgctcc

SEQ ID NO: 771 - DNA, 20 bp, Artificial sequence
  Synthetic oligonucleotide
gtgctgcttattttcatcta

SEQ ID NO: 772 - DNA, 20 bp, Artificial sequence
  Synthetic oligonucleotide
attgatgcacatatccaggc

SEQ ID NO: 773 - DNA, 20 bp, Artificial sequence
  Synthetic oligonucleotide
atctggactctcaccatgca

SEQ ID NO: 774 - DNA, 20 bp, Artificial sequence
  Synthetic oligonucleotide
caccacccttctactcttgt

SEQ ID NO: 775 - DNA, 20 bp, Artificial sequence
  Synthetic oligonucleotide
tttcatattcttcatctggc

SEQ ID NO: 776 - DNA, 20 bp, Artificial sequence
  Synthetic oligonucleotide
aagcatcttttactatctgc

SEQ ID NO: 777 - DNA, 20 bp, Artificial sequence
  Synthetic oligonucleotide
ccagaagtgctttcaaggtc

SEQ ID NO: 778 - DNA, 20 bp, Artificial sequence
  Synthetic oligonucleotide
gcaggtgaataactactgga

SEQ ID NO: 779 - DNA, 20 bp, Artificial sequence
  Synthetic oligonucleotide
ccagactctactcaaggttt

SEQ ID NO: 780 - DNA, 20 bp, Artificial sequence
  Synthetic oligonucleotide
gctcttggcctaatcactct

SEQ ID NO: 781 - DNA, 20 bp, Artificial sequence
  Synthetic oligonucleotide
gaatttcttacactttcaag

SEQ ID NO: 782 - DNA, 20 bp, Artificial sequence
  Synthetic oligonucleotide
ttagcttcttatattgcaca

SEQ ID NO: 783 - DNA, 20 bp, Artificial sequence
  Synthetic oligonucleotide
gcagtcccttcgctttgaat

SEQ ID NO: 784 - DNA, 20 bp, Artificial sequence
  Synthetic oligonucleotide
gccatgaatcctctaagcat

SEQ ID NO: 785 - DNA, 20 bp, Artificial sequence
  Synthetic oligonucleotide
gccacctacaaattgagcct

SEQ ID NO: 786 - DNA, 20 bp, Artificial sequence
  Synthetic oligonucleotide
cttacatcattttcttgcag

SEQ ID NO: 787 - DNA, 20 bp, Artificial sequence
  Synthetic oligonucleotide
ttgcagttctcatatcataa

SEQ ID NO: 788 - DNA, 20 bp, Artificial sequence
  Synthetic oligonucleotide
tggccatgctttatcaggga

SEQ ID NO: 789 - DNA, 20 bp, Artificial sequence
  Synthetic oligonucleotide
ttacactcatttttagtagc

SEQ ID NO: 790 - DNA, 20 bp, Artificial sequence
  Synthetic oligonucleotide
atgctcattacccatcctta

SEQ ID NO: 791 - DNA, 20 bp, Artificial sequence
  Synthetic oligonucleotide
tgcaccaccacacagccctc

SEQ ID NO: 792 - DNA, 20 bp, Artificial sequence
  Synthetic oligonucleotide
tagcatgctaaatcagttct

SEQ ID NO: 793 - DNA, 20 bp, Artificial sequence
  Synthetic oligonucleotide
gcatgtctctttggcgacgg

SEQ ID NO: 794 - DNA, 20 bp, Artificial sequence
  Synthetic oligonucleotide
gtacaagcacagattaactc

SEQ ID NO: 795 - DNA, 20 bp, Artificial sequence
  Synthetic oligonucleotide
gaaggtctctatattttggt

SEQ ID NO: 796 - DNA, 20 bp, Artificial sequence
  Synthetic oligonucleotide
cgtagtgtcataattgctct

SEQ ID NO: 797 - DNA, 20 bp, Artificial sequence
  Synthetic oligonucleotide
tcccattctctcatgaccta

SEQ ID NO: 798 - DNA, 20 bp, Artificial sequence
  Synthetic oligonucleotide
ctactctatcatcacctgga

SEQ ID NO: 799 - DNA, 20 bp, Artificial sequence
  Synthetic oligonucleotide
ccatactgataaatctgcat

SEQ ID NO: 800 - DNA, 20 bp, Artificial sequence
  Synthetic oligonucleotide
acttcatcaatgaagtgcta

SEQ ID NO: 801 - DNA, 20 bp, Artificial sequence
  Synthetic oligonucleotide
accccagcatgctcccacct

SEQ ID NO: 802 - DNA, 20 bp, Artificial sequence
  Synthetic oligonucleotide
taactctattcatcctaccc

SEQ ID NO: 803 - DNA, 20 bp, Artificial sequence
  Synthetic oligonucleotide
tgcttctcaggattcgcacc

SEQ ID NO: 804 - DNA, 20 bp, Artificial sequence
  Synthetic oligonucleotide
gcatcacacaacagctgaca

SEQ ID NO: 805 - DNA, 20 bp, Artificial sequence
  Synthetic oligonucleotide
ggtagtttaattcaccatca

SEQ ID NO: 806 - DNA, 20 bp, Artificial sequence
  Synthetic oligonucleotide
cccatctgcatagtctgtgt

SEQ ID NO: 807 - DNA, 20 bp, Artificial sequence
  Synthetic oligonucleotide
ccagggcctactcctggcca

SEQ ID NO: 808 - DNA, 20 bp, Artificial sequence
  Synthetic oligonucleotide
gctggcatttacaagcatct

SEQ ID NO: 809 - DNA, 20 bp, Artificial sequence
  Synthetic oligonucleotide
aatgctcattacccatcctt

SEQ ID NO: 810 - DNA, 20 bp, Artificial sequence
  Synthetic oligonucleotide
agtctgtcaacccacttgct

SEQ ID NO: 811 - DNA, 20 bp, Artificial sequence
  Synthetic oligonucleotide
tgctaatgtcaccacttact

SEQ ID NO: 812 - DNA, 20 bp, Artificial sequence
  Synthetic oligonucleotide
ttgttacataaaacctgctc

SEQ ID NO: 813 - DNA, 20 bp, Artificial sequence
  Synthetic oligonucleotide
gttgactatttatataagtc

SEQ ID NO: 814 - DNA, 20 bp, Artificial sequence
  Synthetic oligonucleotide
actcttactttcatctggca

SEQ ID NO: 815 - DNA, 20 bp, Artificial sequence
  Synthetic oligonucleotide
cttggttcactaatcatgtt

SEQ ID NO: 816 - DNA, 20 bp, Artificial sequence
  Synthetic oligonucleotide
gtaacaccacccttctactc

SEQ ID NO: 817 - DNA, 20 bp, Artificial sequence
  Synthetic oligonucleotide
cagcaccagaccttctcact

SEQ ID NO: 818 - DNA, 20 bp, Artificial sequence
  Synthetic oligonucleotide
atgcacttgattccatttcc

SEQ ID NO: 819 - DNA, 20 bp, Artificial sequence
  Synthetic oligonucleotide
tgaaggtctctatattttgg

SEQ ID NO: 820 - DNA, 20 bp, Artificial sequence
  Synthetic oligonucleotide
tgcatgtctctttggcgacg

SEQ ID NO: 821 - DNA, 20 bp, Artificial sequence
  Synthetic oligonucleotide
gccatcaattgtcaccacct

SEQ ID NO: 822 - DNA, 20 bp, Artificial sequence
  Synthetic oligonucleotide
tagatacgcaaatccctgcc

SEQ ID NO: 823 - DNA, 20 bp, Artificial sequence
  Synthetic oligonucleotide
agactcatgatctacttcct

SEQ ID NO: 824 - DNA, 20 bp, Artificial sequence
  Synthetic oligonucleotide
attctcttatattccttacc

SEQ ID NO: 825 - DNA, 20 bp, Artificial sequence
  Synthetic oligonucleotide
tggtagttatctctatccct

SEQ ID NO: 826 - DNA, 20 bp, Artificial sequence
  Synthetic oligonucleotide
atcccattctgtctagcccc

SEQ ID NO: 827 - DNA, 20 bp, Artificial sequence
  Synthetic oligonucleotide
tggctactctatcatcacct

SEQ ID NO: 828 - DNA, 20 bp, Artificial sequence
  Synthetic oligonucleotide
gccactgttcatctcatact

SEQ ID NO: 829 - DNA, 20 bp, Artificial sequence
  Synthetic oligonucleotide
gtgctacttataatgcatgt

SEQ ID NO: 830 - DNA, 20 bp, Artificial sequence
  Synthetic oligonucleotide
agtttcatacactcaaggct

SEQ ID NO: 831 - DNA, 20 bp, Artificial sequence
  Synthetic oligonucleotide
atacttgtcaacggcatcag

SEQ ID NO: 832 - DNA, 20 bp, Artificial sequence
  Synthetic oligonucleotide
cgttgaccattcaaaggtcc

SEQ ID NO: 833 - DNA, 20 bp, Artificial sequence
  Synthetic oligonucleotide
ccgcaacaattatctggccc

SEQ ID NO: 834 - DNA, 20 bp, Artificial sequence
  Synthetic oligonucleotide
gctctccctttgtagagccc

SEQ ID NO: 835 - DNA, 20 bp, Artificial sequence
  Synthetic oligonucleotide
cttgattacttcaacttagt

SEQ ID NO: 836 - DNA, 20 bp, Artificial sequence
  Synthetic oligonucleotide
tacaggttttccccacatct

SEQ ID NO: 837 - DNA, 20 bp, Artificial sequence
  Synthetic oligonucleotide
tccagcagtatccacctgct

SEQ ID NO: 838 - DNA, 20 bp, Artificial sequence
  Synthetic oligonucleotide
gggaattcacttcctgctct

SEQ ID NO: 839 - DNA, 20 bp, Artificial sequence
  Synthetic oligonucleotide
gtccagcctatttctctcct

SEQ ID NO: 840 - DNA, 20 bp, Artificial sequence
  Synthetic oligonucleotide
gtaactctattcatcctacc

SEQ ID NO: 841 - DNA, 20 bp, Artificial sequence
  Synthetic oligonucleotide
ttgaatttcttacactttca

SEQ ID NO: 842 - DNA, 20 bp, Artificial sequence
  Synthetic oligonucleotide
atccctgtttcataaagcta

SEQ ID NO: 843 - DNA, 20 bp, Artificial sequence
  Synthetic oligonucleotide
gccatactgataaatctgca

SEQ ID NO: 844 - DNA, 20 bp, Artificial sequence
  Synthetic oligonucleotide
agtccgttcctttccaccct

SEQ ID NO: 845 - DNA, 20 bp, Artificial sequence
  Synthetic oligonucleotide
ctgcaccaccacacagccct

SEQ ID NO: 846 - DNA, 20 bp, Artificial sequence
  Synthetic oligonucleotide
taagtgcagatatttcaata

SEQ ID NO: 847 - DNA, 20 bp, Artificial sequence
  Synthetic oligonucleotide
gctgtctgtaccactctaaa

SEQ ID NO: 848 - DNA, 20 bp, Artificial sequence
  Synthetic oligonucleotide
ctttcatgctaccactgcat

SEQ ID NO: 849 - DNA, 20 bp, Artificial sequence
  Synthetic oligonucleotide
tgccacctacaaattgagcc

SEQ ID NO: 850 - DNA, 20 bp, Artificial sequence
  Synthetic oligonucleotide
cgcctcctacttcctatcct

SEQ ID NO: 851 - DNA, 20 bp, Artificial sequence
  Synthetic oligonucleotide
tcaagctgcatcagccaggc

SEQ ID NO: 852 - DNA, 20 bp, Artificial sequence
  Synthetic oligonucleotide
tccatcttgcactctgttct

SEQ ID NO: 853 - DNA, 20 bp, Artificial sequence
  Synthetic oligonucleotide
agccatgaatcctctaagca

SEQ ID NO: 854 - DNA, 20 bp, Artificial sequence
  Synthetic oligonucleotide
gttcttgcagtcccttcgct

SEQ ID NO: 855 - DNA, 20 bp, Artificial sequence
  Synthetic oligonucleotide
gagtcatgtcttactgttct

SEQ ID NO: 856 - DNA, 20 bp, Artificial sequence
  Synthetic oligonucleotide
gtcaaatgcaacaacttaca

SEQ ID NO: 857 - DNA, 20 bp, Artificial sequence
  Synthetic oligonucleotide
gttgcagttctcatatcata

SEQ ID NO: 858 - DNA, 20 bp, Artificial sequence
  Synthetic oligonucleotide
cttccaacaccccagcatgc

SEQ ID NO: 859 - DNA, 20 bp, Artificial sequence
  Synthetic oligonucleotide
cccgttgatcgatttcccca

SEQ ID NO: 860 - DNA, 20 bp, Artificial sequence
  Synthetic oligonucleotide
gatgtccattagccttgcta

SEQ ID NO: 861 - DNA, 20 bp, Artificial sequence
  Synthetic oligonucleotide
actcaatatcctacctctcc

SEQ ID NO: 862 - DNA, 20 bp, Artificial sequence
  Synthetic oligonucleotide
atggttgtctcctctgtcaa

SEQ ID NO: 863 - DNA, 20 bp, Artificial sequence
  Synthetic oligonucleotide
tcctccattccaatgttctc

SEQ ID NO: 864 - DNA, 20 bp, Artificial sequence
  Synthetic oligonucleotide
accacatgctctcatatgca

SEQ ID NO: 865 - DNA, 20 bp, Artificial sequence
  Synthetic oligonucleotide
gccattgatcacttcatcac

SEQ ID NO: 866 - DNA, 20 bp, Artificial sequence
  Synthetic oligonucleotide
gcagacctattttctaagct

SEQ ID NO: 867 - DNA, 20 bp, Artificial sequence
  Synthetic oligonucleotide
gcaggacttatcactccaca

SEQ ID NO: 868 - DNA, 20 bp, Artificial sequence
  Synthetic oligonucleotide
gctcaattaaaccacagttt

SEQ ID NO: 869 - DNA, 20 bp, Artificial sequence
  Synthetic oligonucleotide
caacttttcaagcaaggaaa

SEQ ID NO: 870 - DNA, 20 bp, Artificial sequence
  Synthetic oligonucleotide
gctcatgaaccctccactcc

SEQ ID NO: 871 - DNA, 20 bp, Artificial sequence
  Synthetic oligonucleotide
atggtattttttcctcccct

SEQ ID NO: 872 - DNA, 20 bp, Artificial sequence
  Synthetic oligonucleotide
atcccatctaaattttgctt

SEQ ID NO: 873 - DNA, 20 bp, Artificial sequence
  Synthetic oligonucleotide
ttgcaccagactctactcaa

SEQ ID NO: 874 - DNA, 20 bp, Artificial sequence
  Synthetic oligonucleotide
ctgcactacattgcttcata

SEQ ID NO: 875 - DNA, 20 bp, Artificial sequence
  Synthetic oligonucleotide
gcttaggccaccctctcttc

SEQ ID NO: 876 - DNA, 20 bp, Artificial sequence
  Synthetic oligonucleotide
ctgggtacataatactaggt

SEQ ID NO: 877 - DNA, 20 bp, Artificial sequence
  Synthetic oligonucleotide
tggcaaaacaaccatatgct

SEQ ID NO: 878 - DNA, 20 bp, Artificial sequence
  Synthetic oligonucleotide
ttggttcattatttaagctt

SEQ ID NO: 879 - DNA, 20 bp, Artificial sequence
  Synthetic oligonucleotide
atagcatgctaaatcagttc

SEQ ID NO: 880 - DNA, 20 bp, Artificial sequence
  Synthetic oligonucleotide
ctgctatacagctacttgta

SEQ ID NO: 881 - DNA, 20 bp, Artificial sequence
  Synthetic oligonucleotide
tctatcagtcataccaggca

SEQ ID NO: 882 - DNA, 20 bp, Artificial sequence
  Synthetic oligonucleotide
cacaaattttatcacatccc

SEQ ID NO: 883 - DNA, 20 bp, Artificial sequence
  Synthetic oligonucleotide
gctcattatctcatttgact

SEQ ID NO: 884 - DNA, 20 bp, Artificial sequence
  Synthetic oligonucleotide
gctgacaaactgtactgggt

SEQ ID NO: 885 - DNA, 20 bp, Artificial sequence
  Synthetic oligonucleotide
ccactcaatatcctacctct

SEQ ID NO: 886 - DNA, 20 bp, Artificial sequence
  Synthetic oligonucleotide
ctacaggttttccccacatc

SEQ ID NO: 887 - DNA, 20 bp, Artificial sequence
  Synthetic oligonucleotide
gcccatccaaagccctacct

SEQ ID NO: 888 - DNA, 20 bp, Artificial sequence
  Synthetic oligonucleotide
gctactcatttattatacaa

SEQ ID NO: 889 - DNA, 20 bp, Artificial sequence
  Synthetic oligonucleotide
catctataataccatctggt

SEQ ID NO: 890 - DNA, 20 bp, Artificial sequence
  Synthetic oligonucleotide
tagcacatttacttatgtgc

SEQ ID NO: 891 - DNA, 20 bp, Artificial sequence
  Synthetic oligonucleotide
ctggtaacaccacccttcta

SEQ ID NO: 892 - DNA, 20 bp, Artificial sequence
  Synthetic oligonucleotide
gatacttgtcaacggcatca

SEQ ID NO: 893 - DNA, 20 bp, Artificial sequence
  Synthetic oligonucleotide
gcaacttttcaagcaaggaa

SEQ ID NO: 894 - DNA, 20 bp, Artificial sequence
  Synthetic oligonucleotide
gcctcaaactctctctgtac

SEQ ID NO: 895 - DNA, 20 bp, Artificial sequence
  Synthetic oligonucleotide
tccagctacatttgcctgtc

SEQ ID NO: 896 - DNA, 20 bp, Artificial sequence
  Synthetic oligonucleotide
cttgcaccagactctactca

SEQ ID NO: 897 - DNA, 20 bp, Artificial sequence
  Synthetic oligonucleotide
tcgaacttgaactatgccat

SEQ ID NO: 898 - DNA, 20 bp, Artificial sequence
  Synthetic oligonucleotide
gtagcattctcttatattcc

SEQ ID NO: 899 - DNA, 20 bp, Artificial sequence
  Synthetic oligonucleotide
ccttggttcactaatcatgt

SEQ ID NO: 900 - DNA, 20 bp, Artificial sequence
  Synthetic oligonucleotide
ccaggtttaaattccaggtt

SEQ ID NO: 901 - DNA, 20 bp, Artificial sequence
  Synthetic oligonucleotide
atgttgctttattcttgctc

SEQ ID NO: 902 - DNA, 20 bp, Artificial sequence
  Synthetic oligonucleotide
tgcacaaattttatcacatc

SEQ ID NO: 903 - DNA, 20 bp, Artificial sequence
  Synthetic oligonucleotide
gcacagttacctccttggga

SEQ ID NO: 904 - DNA, 20 bp, Artificial sequence
  Synthetic oligonucleotide
aagccatgaatcctctaagc

SEQ ID NO: 905 - DNA, 20 bp, Artificial sequence
  Synthetic oligonucleotide
tgctcatgaaccctccactc

SEQ ID NO: 906 - DNA, 20 bp, Artificial sequence
  Synthetic oligonucleotide
gctcatctccccccatttct

SEQ ID NO: 907 - DNA, 20 bp, Artificial sequence
  Synthetic oligonucleotide
ctagagctttttcctagtct

SEQ ID NO: 908 - DNA, 20 bp, Artificial sequence
  Synthetic oligonucleotide
gatttcattttaccccagcc

SEQ ID NO: 909 - DNA, 20 bp, Artificial sequence
  Synthetic oligonucleotide
agtcatcttctctaccgtgt

SEQ ID NO: 910 - DNA, 20 bp, Artificial sequence
  Synthetic oligonucleotide
tgctacccatctgttctcta

SEQ ID NO: 911 - DNA, 20 bp, Artificial sequence
  Synthetic oligonucleotide
cctctctgaatactcagcta

SEQ ID NO: 912 - DNA, 20 bp, Artificial sequence
  Synthetic oligonucleotide
cagtttcatacactcaaggc

SEQ ID NO: 913 - DNA, 20 bp, Artificial sequence
  Synthetic oligonucleotide
gctggcttttttttagcttt

SEQ ID NO: 914 - DNA, 20 bp, Artificial sequence
  Synthetic oligonucleotide
catggttgtctcctctgtca

SEQ ID NO: 915 - DNA, 20 bp, Artificial sequence
  Synthetic oligonucleotide
acatcccattctgtctagcc

SEQ ID NO: 916 - DNA, 20 bp, Artificial sequence
  Synthetic oligonucleotide
gcataggtttaaattctaac

SEQ ID NO: 917 - DNA, 20 bp, Artificial sequence
  Synthetic oligonucleotide
cctcttttcatcagagccca

SEQ ID NO: 918 - DNA, 20 bp, Artificial sequence
  Synthetic oligonucleotide
aagctactcttctaccccaa

SEQ ID NO: 919 - DNA, 20 bp, Artificial sequence
  Synthetic oligonucleotide
acagcttcttccatccactg

SEQ ID NO: 920 - DNA, 20 bp, Artificial sequence
  Synthetic oligonucleotide
ctccaacctaagcctttact

SEQ ID NO: 921 - DNA, 20 bp, Artificial sequence
  Synthetic oligonucleotide
gctgcaccaccacacagccc

SEQ ID NO: 922 - DNA, 20 bp, Artificial sequence
  Synthetic oligonucleotide
tgatagcatgctaaatcagt

SEQ ID NO: 923 - DNA, 20 bp, Artificial sequence
  Synthetic oligonucleotide
ttggttgtagaacccaacca

SEQ ID NO: 924 - DNA, 20 bp, Artificial sequence
  Synthetic oligonucleotide
gcatacaacaaactcagctc

SEQ ID NO: 925 - DNA, 20 bp, Artificial sequence
  Synthetic oligonucleotide
tggcaggacttatcactcca

SEQ ID NO: 926 - DNA, 20 bp, Artificial sequence
  Synthetic oligonucleotide
cttaatgctcattacccatc

SEQ ID NO: 927 - DNA, 20 bp, Artificial sequence
  Synthetic oligonucleotide
cttcttccaacaccccagca

SEQ ID NO: 928 - DNA, 20 bp, Artificial sequence
  Synthetic oligonucleotide
ggcttctaccacattggtga

SEQ ID NO: 929 - DNA, 20 bp, Artificial sequence
  Synthetic oligonucleotide
cagtccgttcctttccaccc

SEQ ID NO: 930 - DNA, 20 bp, Artificial sequence
  Synthetic oligonucleotide
ggtccagcctatttctctcc

SEQ ID NO: 931 - DNA, 20 bp, Artificial sequence
  Synthetic oligonucleotide
ctgcatgtctacaaagtgta

SEQ ID NO: 932 - DNA, 20 bp, Artificial sequence
  Synthetic oligonucleotide
gcacaggacaatcatccgca

SEQ ID NO: 933 - DNA, 20 bp, Artificial sequence
  Synthetic oligonucleotide
actcatggcttccctgctca

SEQ ID NO: 934 - DNA, 20 bp, Artificial sequence
  Synthetic oligonucleotide
gctctgttctagtacaacca

SEQ ID NO: 935 - DNA, 20 bp, Artificial sequence
  Synthetic oligonucleotide
gatggtctcacccaaagaac

SEQ ID NO: 936 - DNA, 20 bp, Artificial sequence
  Synthetic oligonucleotide
atggctactctatcatcacc

SEQ ID NO: 937 - DNA, 20 bp, Artificial sequence
  Synthetic oligonucleotide
ccttcttacaattatgctct

SEQ ID NO: 938 - DNA, 20 bp, Artificial sequence
  Synthetic oligonucleotide
tgccactgttcatctcatac

SEQ ID NO: 939 - DNA, 20 bp, Artificial sequence
  Synthetic oligonucleotide
tcacattccctcatcagcac

SEQ ID NO: 940 - DNA, 20 bp, Artificial sequence
  Synthetic oligonucleotide
tgttgaatttcttacacttt

SEQ ID NO: 941 - DNA, 20 bp, Artificial sequence
  Synthetic oligonucleotide
gtactacaaatcagatgtcc

SEQ ID NO: 942 - DNA, 20 bp, Artificial sequence
  Synthetic oligonucleotide
tctcctccattccaatgttc

SEQ ID NO: 943 - DNA, 20 bp, Artificial sequence
  Synthetic oligonucleotide
tggttccccaactccacagt

SEQ ID NO: 944 - DNA, 20 bp, Artificial sequence
  Synthetic oligonucleotide
attgaaggtctctatatttt

SEQ ID NO: 945 - DNA, 20 bp, Artificial sequence
  Synthetic oligonucleotide
atgcaatatcatattcatca

SEQ ID NO: 946 - DNA, 20 bp, Artificial sequence
  Synthetic oligonucleotide
actttgttatactatccagc

SEQ ID NO: 947 - DNA, 20 bp, Artificial sequence
  Synthetic oligonucleotide
aagagatccatctctgctca

SEQ ID NO: 948 - DNA, 20 bp, Artificial sequence
  Synthetic oligonucleotide
ccctcattcatccagggcct

SEQ ID NO: 949 - DNA, 20 bp, Artificial sequence
  Synthetic oligonucleotide
tcatttcttttctacagcca

SEQ ID NO: 950 - DNA, 20 bp, Artificial sequence
  Synthetic oligonucleotide
tgcactcttatctttcccct

SEQ ID NO: 951 - DNA, 20 bp, Artificial sequence
  Synthetic oligonucleotide
ggtttatgttcaaactgtct

SEQ ID NO: 952 - DNA, 20 bp, Artificial sequence
  Synthetic oligonucleotide
atgcctctgatacactgact

SEQ ID NO: 953 - DNA, 20 bp, Artificial sequence
  Synthetic oligonucleotide
ctgccattgatcacttcatc

SEQ ID NO: 954 - DNA, 20 bp, Artificial sequence
  Synthetic oligonucleotide
ggtaactctattcatcctac

SEQ ID NO: 955 - DNA, 20 bp, Artificial sequence
  Synthetic oligonucleotide
gccactgctaatgtcaccac

SEQ ID NO: 956 - DNA, 20 bp, Artificial sequence
  Synthetic oligonucleotide
tactcttactttcatctggc

SEQ ID NO: 957 - DNA, 20 bp, Artificial sequence
  Synthetic oligonucleotide
tcccatctgcatagtctgtg

SEQ ID NO: 958 - DNA, 20 bp, Artificial sequence
  Synthetic oligonucleotide
acggcatgacaatcttggga

SEQ ID NO: 959 - DNA, 20 bp, Artificial sequence
  Synthetic oligonucleotide
cagcaaccaatgccatgtct

SEQ ID NO: 960 - DNA, 20 bp, Artificial sequence
  Synthetic oligonucleotide
agatacttgtcaacggcatc

SEQ ID NO: 961 - DNA, 20 bp, Artificial sequence
  Synthetic oligonucleotide
ctcccatctgcatagtctgt

SEQ ID NO: 962 - DNA, 20 bp, Artificial sequence
  Synthetic oligonucleotide
tcaccagtttcatacactca

SEQ ID NO: 963 - DNA, 20 bp, Artificial sequence
  Synthetic oligonucleotide
tggtaactctattcatccta

SEQ ID NO: 964 - DNA, 20 bp, Artificial sequence
  Synthetic oligonucleotide
gcttctctctctataacacc

SEQ ID NO: 965 - DNA, 20 bp, Artificial sequence
  Synthetic oligonucleotide
gaggtgcccacacatgcaca

SEQ ID NO: 966 - DNA, 20 bp, Artificial sequence
  Synthetic oligonucleotide
gcactgcttttctatttcca

SEQ ID NO: 967 - DNA, 20 bp, Artificial sequence
  Synthetic oligonucleotide
agctactcatttattataca

SEQ ID NO: 968 - DNA, 20 bp, Artificial sequence
  Synthetic oligonucleotide
tgttaattcatagactctcc

SEQ ID NO: 969 - DNA, 20 bp, Artificial sequence
  Synthetic oligonucleotide
tcagtccgttcctttccacc

SEQ ID NO: 970 - DNA, 20 bp, Artificial sequence
  Synthetic oligonucleotide
tcggaacatttatactattt

SEQ ID NO: 971 - DNA, 20 bp, Artificial sequence
  Synthetic oligonucleotide
agcctcttttcatcagagcc

SEQ ID NO: 972 - DNA, 20 bp, Artificial sequence
  Synthetic oligonucleotide
tgctcattatctcatttgac

SEQ ID NO: 973 - DNA, 20 bp, Artificial sequence
  Synthetic oligonucleotide
atgctcccactgaatggctc

SEQ ID NO: 974 - DNA, 20 bp, Artificial sequence
  Synthetic oligonucleotide
gcgcatttactagcacattt

SEQ ID NO: 975 - DNA, 20 bp, Artificial sequence
  Synthetic oligonucleotide
gcagcaggtttccataaact

SEQ ID NO: 976 - DNA, 20 bp, Artificial sequence
  Synthetic oligonucleotide
ctgtttagtattcacaacat

SEQ ID NO: 977 - DNA, 20 bp, Artificial sequence
  Synthetic oligonucleotide
gccttacagatcctcatctt

SEQ ID NO: 978 - DNA, 20 bp, Artificial sequence
  Synthetic oligonucleotide
tcatatctaattcagtgttc

SEQ ID NO: 979 - DNA, 20 bp, Artificial sequence
  Synthetic oligonucleotide
acgggccactgctaatgtca

SEQ ID NO: 980 - DNA, 20 bp, Artificial sequence
  Synthetic oligonucleotide
tggtccagcctatttctctc

SEQ ID NO: 981 - DNA, 20 bp, Artificial sequence
  Synthetic oligonucleotide
gtaagctactcttctacccc

SEQ ID NO: 982 - DNA, 20 bp, Artificial sequence
  Synthetic oligonucleotide
cccttcttacaattatgctc

SEQ ID NO: 983 - DNA, 20 bp, Artificial sequence
  Synthetic oligonucleotide
gctagagctttttcctagtc

SEQ ID NO: 984 - DNA, 20 bp, Artificial sequence
  Synthetic oligonucleotide
ccaagattacttcttttcct

SEQ ID NO: 985 - DNA, 20 bp, Artificial sequence
  Synthetic oligonucleotide
gtcactcataactcatgctt

SEQ ID NO: 986 - DNA, 20 bp, Artificial sequence
  Synthetic oligonucleotide
gctgtccaacttcagaggct

SEQ ID NO: 987 - DNA, 20 bp, Artificial sequence
  Synthetic oligonucleotide
gctatgctatcttaacgcat

SEQ ID NO: 988 - DNA, 20 bp, Artificial sequence
  Synthetic oligonucleotide
tggagatttatcctatacta

SEQ ID NO: 989 - DNA, 20 bp, Artificial sequence
  Synthetic oligonucleotide
gcatgtttcttcaacatgta

SEQ ID NO: 990 - DNA, 20 bp, Artificial sequence
  Synthetic oligonucleotide
atccttggttcactaatcat

SEQ ID NO: 991 - DNA, 20 bp, Artificial sequence
  Synthetic oligonucleotide
ctgcatgtctctttggcgac

SEQ ID NO: 992 - DNA, 20 bp, Artificial sequence
  Synthetic oligonucleotide
atgcaccatctataatacca

SEQ ID NO: 993 - DNA, 20 bp, Artificial sequence
  Synthetic oligonucleotide
gctcacaacaacccctcata

SEQ ID NO: 994 - DNA, 20 bp, Artificial sequence
  Synthetic oligonucleotide
gaggattctttgctacccat

SEQ ID NO: 995 - DNA, 20 bp, Artificial sequence
  Synthetic oligonucleotide
atgccatcacttgaacggca

SEQ ID NO: 996 - DNA, 20 bp, Artificial sequence
  Synthetic oligonucleotide
gcactattctctcttgtgta

SEQ ID NO: 997 - DNA, 20 bp, Artificial sequence
  Synthetic oligonucleotide
ggatcttcattctctaagct

SEQ ID NO: 998 - DNA, 20 bp, Artificial sequence
  Synthetic oligonucleotide
gctgtagtacccttttctct

SEQ ID NO: 999 - DNA, 20 bp, Artificial sequence
  Synthetic oligonucleotide
gctgatttcattttacccca

SEQ ID NO: 1000 - DNA, 20 bp, Artificial sequence
  Synthetic oligonucleotide
gcccactatcttttaagttt

SEQ ID NO: 1001 - DNA, 20 bp, Artificial sequence
  Synthetic oligonucleotide
ccttaatgctcattacccat

SEQ ID NO: 1002 - DNA, 20 bp, Artificial sequence
  Synthetic oligonucleotide
ttggcaggacttatcactcc

SEQ ID NO: 1003 - DNA, 20 bp, Artificial sequence
  Synthetic oligonucleotide
actacaggttttccccacat

SEQ ID NO: 1004 - DNA, 20 bp, Artificial sequence
  Synthetic oligonucleotide
gtgcaacttttcaagcaagg

SEQ ID NO: 1005 - DNA, 20 bp, Artificial sequence
  Synthetic oligonucleotide
atgttgaatttcttacactt

SEQ ID NO: 1006 - DNA, 20 bp, Artificial sequence
  Synthetic oligonucleotide
cccccaaatttttcatggca

SEQ ID NO: 1007 - DNA, 20 bp, Artificial sequence
  Synthetic oligonucleotide
gtgtatttatcatatttgct

SEQ ID NO: 1008 - DNA, 20 bp, Artificial sequence
  Synthetic oligonucleotide
ttgcactcttatctttcccc

SEQ ID NO: 1009 - DNA, 20 bp, Artificial sequence
  Synthetic oligonucleotide
acttgcaccagactctactc

SEQ ID NO: 1010 - DNA, 20 bp, Artificial sequence
  Synthetic oligonucleotide
tgtgtctttttccatgtgca

SEQ ID NO: 1011 - DNA, 20 bp, Artificial sequence
  Synthetic oligonucleotide
gctcagtcatatttgcaaat

SEQ ID NO: 1012 - DNA, 20 bp, Artificial sequence
  Synthetic oligonucleotide
gttcaggaactcctttgcta

SEQ ID NO: 1013 - DNA, 20 bp, Artificial sequence
  Synthetic oligonucleotide
gcctgagagactcatccctc

SEQ ID NO: 1014 - DNA, 20 bp, Artificial sequence
  Synthetic oligonucleotide
ttggcttctaccacattggt

SEQ ID NO: 1015 - DNA, 20 bp, Artificial sequence
  Synthetic oligonucleotide
ccctggtaacaccacccttc

SEQ ID NO: 1016 - DNA, 20 bp, Artificial sequence
  Synthetic oligonucleotide
gcttcttccaacaccccagc

SEQ ID NO: 1017 - DNA, 20 bp, Artificial sequence
  Synthetic oligonucleotide
gttagcctttccttatctgt

SEQ ID NO: 1018 - DNA, 20 bp, Artificial sequence
  Synthetic oligonucleotide
tatccactggaccttcccta

SEQ ID NO: 1019 - DNA, 20 bp, Artificial sequence
  Synthetic oligonucleotide
ctgctcatgaaccctccact

SEQ ID NO: 1020 - DNA, 20 bp, Artificial sequence
  Synthetic oligonucleotide
ctagagtgctttcatggcca

SEQ ID NO: 1021 - DNA, 20 bp, Artificial sequence
  Synthetic oligonucleotide
gctcaattcaatcacattcc

SEQ ID NO: 1022 - DNA, 20 bp, Artificial sequence
  Synthetic oligonucleotide
tccctcattcatccagggcc

SEQ ID NO: 1023 - DNA, 20 bp, Artificial sequence
  Synthetic oligonucleotide
gtattttctcaactttgtac

SEQ ID NO: 1024 - DNA, 20 bp, Artificial sequence
  Synthetic oligonucleotide
cccacagtactttattctgt

SEQ ID NO: 1025 - DNA, 20 bp, Artificial sequence
  Synthetic oligonucleotide
cgtagcattctcttatattc

SEQ ID NO: 1026 - DNA, 20 bp, Artificial sequence
  Synthetic oligonucleotide
gctactatacctcacagccc

SEQ ID NO: 1027 - DNA, 20 bp, Artificial sequence
  Synthetic oligonucleotide
gtggatttcatctttccatc

SEQ ID NO: 1028 - DNA, 20 bp, Artificial sequence
  Synthetic oligonucleotide
gccactcaatatcctacctc

SEQ ID NO: 1029 - DNA, 20 bp, Artificial sequence
  Synthetic oligonucleotide
gctgtaggccctcccccacc

SEQ ID NO: 1030 - DNA, 20 bp, Artificial sequence
  Synthetic oligonucleotide
acatggctactctatcatca

SEQ ID NO: 1031 - DNA, 20 bp, Artificial sequence
  Synthetic oligonucleotide
tcaagagatccatctctgct

SEQ ID NO: 1032 - DNA, 20 bp, Artificial sequence
  Synthetic oligonucleotide
ggaagacatccttccagctt

SEQ ID NO: 1033 - DNA, 20 bp, Artificial sequence
  Synthetic oligonucleotide
cctacaagccatgaatcctc

SEQ ID NO: 1034 - DNA, 20 bp, Artificial sequence
  Synthetic oligonucleotide
ggacaatgactaattcctca

SEQ ID NO: 1035 - DNA, 20 bp, Artificial sequence
  Synthetic oligonucleotide
ccttgttcacctgttacctc

SEQ ID NO: 1036 - DNA, 20 bp, Artificial sequence
  Synthetic oligonucleotide
ctaccttctcctccattcca

SEQ ID NO: 1037 - DNA, 20 bp, Artificial sequence
  Synthetic oligonucleotide
gagatacttgtcaacggcat

SEQ ID NO: 1038 - DNA, 20 bp, Artificial sequence
  Synthetic oligonucleotide
actgcatgtctctttggcga

SEQ ID NO: 1039 - DNA, 20 bp, Artificial sequence
  Synthetic oligonucleotide
gccaagattacttcttttcc

SEQ ID NO: 1040 - DNA, 20 bp, Artificial sequence
  Synthetic oligonucleotide
ggccttacagatcctcatct

SEQ ID NO: 1041 - DNA, 20 bp, Artificial sequence
  Synthetic oligonucleotide
tcttcagattcctatggtaa

SEQ ID NO: 1042 - DNA, 20 bp, Artificial sequence
  Synthetic oligonucleotide
ctatgctcacaacaacccct

SEQ ID NO: 1043 - DNA, 20 bp, Artificial sequence
  Synthetic oligonucleotide
tgccactcaatatcctacct

SEQ ID NO: 1044 - DNA, 20 bp, Artificial sequence
  Synthetic oligonucleotide
gtcctcacccatcaaggtac

SEQ ID NO: 1045 - DNA, 20 bp, Artificial sequence
  Synthetic oligonucleotide
agctgatttcattttacccc

SEQ ID NO: 1046 - DNA, 20 bp, Artificial sequence
  Synthetic oligonucleotide
ggtacatccatctacaacat

SEQ ID NO: 1047 - DNA, 20 bp, Artificial sequence
  Synthetic oligonucleotide
gcagtttacctccatatctc

SEQ ID NO: 1048 - DNA, 20 bp, Artificial sequence
  Synthetic oligonucleotide
ttggttggcttctaccacat

SEQ ID NO: 1049 - DNA, 20 bp, Artificial sequence
  Synthetic oligonucleotide
atcaccagtttcatacactc

SEQ ID NO: 1050 - DNA, 20 bp, Artificial sequence
  Synthetic oligonucleotide
gagcacatacatcaatagtt

SEQ ID NO: 1051 - DNA, 20 bp, Artificial sequence
  Synthetic oligonucleotide
acactctgatctatgggtca

SEQ ID NO: 1052 - DNA, 20 bp, Artificial sequence
  Synthetic oligonucleotide
tcccttcttacaattatgct

SEQ ID NO: 1053 - DNA, 20 bp, Artificial sequence
  Synthetic oligonucleotide
tgcccaggctcatttggtcc

SEQ ID NO: 1054 - DNA, 20 bp, Artificial sequence
  Synthetic oligonucleotide
gtactaccttctcctccatt

SEQ ID NO: 1055 - DNA, 20 bp, Artificial sequence
  Synthetic oligonucleotide
cctctgttcaactcatcgga

SEQ ID NO: 1056 - DNA, 20 bp, Artificial sequence
  Synthetic oligonucleotide
cccacctcatctgtcagctc

SEQ ID NO: 1057 - DNA, 20 bp, Artificial sequence
  Synthetic oligonucleotide
gcctactcagaactacaggt

SEQ ID NO: 1058 - DNA, 20 bp, Artificial sequence
  Synthetic oligonucleotide
acccattagacatttcagca

SEQ ID NO: 1059 - DNA, 20 bp, Artificial sequence
  Synthetic oligonucleotide
atgcctcatttcatatctaa

SEQ ID NO: 1060 - DNA, 20 bp, Artificial sequence
  Synthetic oligonucleotide
tggaccatcatctagatgca

SEQ ID NO: 1061 - DNA, 20 bp, Artificial sequence
  Synthetic oligonucleotide
atcaagcaattcttcaggca

SEQ ID NO: 1062 - DNA, 20 bp, Artificial sequence
  Synthetic oligonucleotide
gcagatgtcctaatttcctt

SEQ ID NO: 1063 - DNA, 20 bp, Artificial sequence
  Synthetic oligonucleotide
gacaagttttcactaactac

SEQ ID NO: 1064 - DNA, 20 bp, Artificial sequence
  Synthetic oligonucleotide
ctccaattttaacttgcacc

SEQ ID NO: 1065 - DNA, 20 bp, Artificial sequence
  Synthetic oligonucleotide
tgagccctatgaactgtttc

SEQ ID NO: 1066 - DNA, 20 bp, Artificial sequence
  Synthetic oligonucleotide
cttgcactcttatctttccc

SEQ ID NO: 1067 - DNA, 20 bp, Artificial sequence
  Synthetic oligonucleotide
ttgccatatctcatcagcct

SEQ ID NO: 1068 - DNA, 20 bp, Artificial sequence
  Synthetic oligonucleotide
tgaggctcatttcaaactct

SEQ ID NO: 1069 - DNA, 20 bp, Artificial sequence
  Synthetic oligonucleotide
cgccattgttcccacagtac

SEQ ID NO: 1070 - DNA, 20 bp, Artificial sequence
  Synthetic oligonucleotide
gcatatattttattacacca

SEQ ID NO: 1071 - DNA, 20 bp, Artificial sequence
  Synthetic oligonucleotide
ggtgcaacttttcaagcaag

SEQ ID NO: 1072 - DNA, 20 bp, Artificial sequence
  Synthetic oligonucleotide
tggattcatctccatactca

SEQ ID NO: 1073 - DNA, 20 bp, Artificial sequence
  Synthetic oligonucleotide
acttcatatttttatccccc

SEQ ID NO: 1074 - DNA, 20 bp, Artificial sequence
  Synthetic oligonucleotide
gcactttctcttctccatgc

SEQ ID NO: 1075 - DNA, 20 bp, Artificial sequence
  Synthetic oligonucleotide
cctgtattacatcataatta

SEQ ID NO: 1076 - DNA, 20 bp, Artificial sequence
  Synthetic oligonucleotide
gccaaatactcacatggcta

SEQ ID NO: 1077 - DNA, 20 bp, Artificial sequence
  Synthetic oligonucleotide
ctgcatctcatcctatagat

SEQ ID NO: 1078 - DNA, 20 bp, Artificial sequence
  Synthetic oligonucleotide
ctagaatgtcattctccgct

SEQ ID NO: 1079 - DNA, 20 bp, Artificial sequence
  Synthetic oligonucleotide
aagctaaatctctattgcat

SEQ ID NO: 1080 - DNA, 20 bp, Artificial sequence
  Synthetic oligonucleotide
ccactgttattacaatggtc

SEQ ID NO: 1081 - DNA, 20 bp, Artificial sequence
  Synthetic oligonucleotide
gcctggtaactctattcatc

SEQ ID NO: 1082 - DNA, 20 bp, Artificial sequence
  Synthetic oligonucleotide
actccttgttcacctgttac

SEQ ID NO: 1083 - DNA, 20 bp, Artificial sequence
  Synthetic oligonucleotide
aatcataaaacgggtttgtt

SEQ ID NO: 1084 - DNA, 20 bp, Artificial sequence
  Synthetic oligonucleotide
tcatccctgctcatgaaccc

SEQ ID NO: 1085 - DNA, 20 bp, Artificial sequence
  Synthetic oligonucleotide
tgtggatttcatctttccat

SEQ ID NO: 1086 - DNA, 20 bp, Artificial sequence
  Synthetic oligonucleotide
atttcactaaccggcaaaac

SEQ ID NO: 1087 - DNA, 20 bp, Artificial sequence
  Synthetic oligonucleotide
gctgtaggatcttcattctc

SEQ ID NO: 1088 - DNA, 20 bp, Artificial sequence
  Synthetic oligonucleotide
tcccttctctaaatcaggcc

SEQ ID NO: 1089 - DNA, 20 bp, Artificial sequence
  Synthetic oligonucleotide
agctgataaagataccatcc

SEQ ID NO: 1090 - DNA, 20 bp, Artificial sequence
  Synthetic oligonucleotide
actgattatcaaattccgga

SEQ ID NO: 1091 - DNA, 20 bp, Artificial sequence
  Synthetic oligonucleotide
gcatttttctctcttcaagc

SEQ ID NO: 1092 - DNA, 20 bp, Artificial sequence
  Synthetic oligonucleotide
ttcagcgcactattctctct

SEQ ID NO: 1093 - DNA, 20 bp, Artificial sequence
  Synthetic oligonucleotide
gcttcataacaccagccttc

SEQ ID NO: 1094 - DNA, 20 bp, Artificial sequence
  Synthetic oligonucleotide
cctcccatctgcatagtctg

SEQ ID NO: 1095 - DNA, 20 bp, Artificial sequence
  Synthetic oligonucleotide
tccttaatgctcattaccca

SEQ ID NO: 1096 - DNA, 20 bp, Artificial sequence
  Synthetic oligonucleotide
gcttcatacatcctctaact

SEQ ID NO: 1097 - DNA, 20 bp, Artificial sequence
  Synthetic oligonucleotide
gtgcttcttccaacacccca

SEQ ID NO: 1098 - DNA, 20 bp, Artificial sequence
  Synthetic oligonucleotide
ttcatagtctatcttttgct

SEQ ID NO: 1099 - DNA, 20 bp, Artificial sequence
  Synthetic oligonucleotide
gcatcaggctaacaagttca

SEQ ID NO: 1100 - DNA, 20 bp, Artificial sequence
  Synthetic oligonucleotide
gcacaagacctcatccaggc

SEQ ID NO: 1101 - DNA, 20 bp, Artificial sequence
  Synthetic oligonucleotide
ctctctgttaccacgcctct

SEQ ID NO: 1102 - DNA, 20 bp, Artificial sequence
  Synthetic oligonucleotide
gtacttttaactcattccta

SEQ ID NO: 1103 - DNA, 20 bp, Artificial sequence
  Synthetic oligonucleotide
tggtaaatatccactggacc

SEQ ID NO: 1104 - DNA, 20 bp, Artificial sequence
  Synthetic oligonucleotide
gcacagccaagactacggtc

SEQ ID NO: 1105 - DNA, 20 bp, Artificial sequence
  Synthetic oligonucleotide
tgtaagctactcttctaccc

SEQ ID NO: 1106 - DNA, 20 bp, Artificial sequence
  Synthetic oligonucleotide
gggctactatacctcacagc

SEQ ID NO: 1107 - DNA, 20 bp, Artificial sequence
  Synthetic oligonucleotide
tggaagacatccttccagct

SEQ ID NO: 1108 - DNA, 20 bp, Artificial sequence
  Synthetic oligonucleotide
tcggcttctacctttagcga

SEQ ID NO: 1109 - DNA, 20 bp, Artificial sequence
  Synthetic oligonucleotide
gatgttgaatttcttacact

SEQ ID NO: 1110 - DNA, 20 bp, Artificial sequence
  Synthetic oligonucleotide
acttcatgctcccactgaat

SEQ ID NO: 1111 - DNA, 20 bp, Artificial sequence
  Synthetic oligonucleotide
ccccacatccaaaccctggt

SEQ ID NO: 1112 - DNA, 20 bp, Artificial sequence
  Synthetic oligonucleotide
ccgtaactgatccttggttc

SEQ ID NO: 1113 - DNA, 20 bp, Artificial sequence
  Synthetic oligonucleotide
ttgcattcacaacacacatc

SEQ ID NO: 1114 - DNA, 20 bp, Artificial sequence
  Synthetic oligonucleotide
gctcaacactcaatagatga

SEQ ID NO: 1115 - DNA, 20 bp, Artificial sequence
  Synthetic oligonucleotide
gaccctacatcatctcatat

SEQ ID NO: 1116 - DNA, 20 bp, Artificial sequence
  Synthetic oligonucleotide
tctctctgttaccacgcctc

SEQ ID NO: 1117 - DNA, 20 bp, Artificial sequence
  Synthetic oligonucleotide
atgtactgatttcatagtct

SEQ ID NO: 1118 - DNA, 20 bp, Artificial sequence
  Synthetic oligonucleotide
attcagcgcactattctctc

SEQ ID NO: 1119 - DNA, 20 bp, Artificial sequence
  Synthetic oligonucleotide
ttcccactctgctcctcgct

SEQ ID NO: 1120 - DNA, 20 bp, Artificial sequence
  Synthetic oligonucleotide
gttgccactcaatatcctac

SEQ ID NO: 1121 - DNA, 20 bp, Artificial sequence
  Synthetic oligonucleotide
gcacagatgctaatcaccat

SEQ ID NO: 1122 - DNA, 20 bp, Artificial sequence
  Synthetic oligonucleotide
tcggacttactgtaatgggt

SEQ ID NO: 1123 - DNA, 20 bp, Artificial sequence
  Synthetic oligonucleotide
tggactatttcccacccggc

SEQ ID NO: 1124 - DNA, 20 bp, Artificial sequence
  Synthetic oligonucleotide
agccaaatactcacatggct

SEQ ID NO: 1125 - DNA, 20 bp, Artificial sequence
  Synthetic oligonucleotide
ctggaagacatccttccagc

SEQ ID NO: 1126 - DNA, 20 bp, Artificial sequence
  Synthetic oligonucleotide
ggtcattaactttactatca

SEQ ID NO: 1127 - DNA, 20 bp, Artificial sequence
  Synthetic oligonucleotide
gctgcatgcttccaattgca

SEQ ID NO: 1128 - DNA, 20 bp, Artificial sequence
  Synthetic oligonucleotide
ctcctatgctcacaacaacc

SEQ ID NO: 1129 - DNA, 20 bp, Artificial sequence
  Synthetic oligonucleotide
cgagatacttgtcaacggca

SEQ ID NO: 1130 - DNA, 20 bp, Artificial sequence
  Synthetic oligonucleotide
gaacctgtattacatcataa

SEQ ID NO: 1131 - DNA, 20 bp, Artificial sequence
  Synthetic oligonucleotide
acctcccatctgcatagtct

SEQ ID NO: 1132 - DNA, 20 bp, Artificial sequence
  Synthetic oligonucleotide
gccacacataacaagcattt

SEQ ID NO: 1133 - DNA, 20 bp, Artificial sequence
  Synthetic oligonucleotide
agtgttttttcttcagggtt

SEQ ID NO: 1134 - DNA, 20 bp, Artificial sequence
  Synthetic oligonucleotide
aggtgcaacttttcaagcaa

SEQ ID NO: 1135 - DNA, 20 bp, Artificial sequence
  Synthetic oligonucleotide
gcaggcaatagaccacttca

SEQ ID NO: 1136 - DNA, 20 bp, Artificial sequence
  Synthetic oligonucleotide
gcttgttaactacatgggtc

SEQ ID NO: 1137 - DNA, 20 bp, Artificial sequence
  Synthetic oligonucleotide
tggcagttatacacagatcc

SEQ ID NO: 1138 - DNA, 20 bp, Artificial sequence
  Synthetic oligonucleotide
tttgtcctatttattcctca

SEQ ID NO: 1139 - DNA, 20 bp, Artificial sequence
  Synthetic oligonucleotide
gcccacctcatctgtcagct

SEQ ID NO: 1140 - DNA, 20 bp, Artificial sequence
  Synthetic oligonucleotide
ggagcatcctctttttcttc

SEQ ID NO: 1141 - DNA, 20 bp, Artificial sequence
  Synthetic oligonucleotide
tgtggaatactatattatca

SEQ ID NO: 1142 - DNA, 20 bp, Artificial sequence
  Synthetic oligonucleotide
tctgagctctcactatgaaa

SEQ ID NO: 1143 - DNA, 20 bp, Artificial sequence
  Synthetic oligonucleotide
aggaacttctgactaccata

SEQ ID NO: 1144 - DNA, 20 bp, Artificial sequence
  Synthetic oligonucleotide
cagtggtttaatcccttctc

SEQ ID NO: 1145 - DNA, 20 bp, Artificial sequence
  Synthetic oligonucleotide
gttgggctactatacctcac

SEQ ID NO: 1146 - DNA, 20 bp, Artificial sequence
  Synthetic oligonucleotide
agccaagattacttcttttc

SEQ ID NO: 1147 - DNA, 20 bp, Artificial sequence
  Synthetic oligonucleotide
tgtactaccttctcctccat

SEQ ID NO: 1148 - DNA, 20 bp, Artificial sequence
  Synthetic oligonucleotide
gctgaactctccattcacgg

SEQ ID NO: 1149 - DNA, 20 bp, Artificial sequence
  Synthetic oligonucleotide
gcttgcactcttatctttcc

SEQ ID NO: 1150 - DNA, 20 bp, Artificial sequence
  Synthetic oligonucleotide
tgacaagttttcactaacta

SEQ ID NO: 1151 - DNA, 20 bp, Artificial sequence
  Synthetic oligonucleotide
agagaactttgacaatacta

SEQ ID NO: 1152 - DNA, 20 bp, Artificial sequence
  Synthetic oligonucleotide
tcatggtttctcatcgatta

SEQ ID NO: 1153 - DNA, 20 bp, Artificial sequence
  Synthetic oligonucleotide
acccacttcatgctcccact

SEQ ID NO: 1154 - DNA, 20 bp, Artificial sequence
  Synthetic oligonucleotide
ggtcagcattttcctagtca

SEQ ID NO: 1155 - DNA, 20 bp, Artificial sequence
  Synthetic oligonucleotide
gttcaagctaaatctctatt

SEQ ID NO: 1156 - DNA, 20 bp, Artificial sequence
  Synthetic oligonucleotide
gtggcatctactgctaggac

SEQ ID NO: 1157 - DNA, 20 bp, Artificial sequence
  Synthetic oligonucleotide
tccttgtacttttaactcat

SEQ ID NO: 1158 - DNA, 20 bp, Artificial sequence
  Synthetic oligonucleotide
gccaacttctctgcaacata

SEQ ID NO: 1159 - DNA, 20 bp, Artificial sequence
  Synthetic oligonucleotide
acatcgcctcacttccccca

SEQ ID NO: 1160 - DNA, 20 bp, Artificial sequence
  Synthetic oligonucleotide
gcataccatcttcagattcc

SEQ ID NO: 1161 - DNA, 20 bp, Artificial sequence
  Synthetic oligonucleotide
gcacaccaagtcaacattcc

SEQ ID NO: 1162 - DNA, 20 bp, Artificial sequence
  Synthetic oligonucleotide
actccagcctcacataggga

SEQ ID NO: 1163 - DNA, 20 bp, Artificial sequence
  Synthetic oligonucleotide
gtttggtttttctatacttc

SEQ ID NO: 1164 - DNA, 20 bp, Artificial sequence
  Synthetic oligonucleotide
gtatcaccagtttcatacac

SEQ ID NO: 1165 - DNA, 20 bp, Artificial sequence
  Synthetic oligonucleotide
gagcaacttacaaggcagac

SEQ ID NO: 1166 - DNA, 20 bp, Artificial sequence
  Synthetic oligonucleotide
cacactctgatctatgggtc

SEQ ID NO: 1167 - DNA, 20 bp, Artificial sequence
  Synthetic oligonucleotide
cagcaagccagattactgtc

SEQ ID NO: 1168 - DNA, 20 bp, Artificial sequence
  Synthetic oligonucleotide
tgtgcttcttccaacacccc

SEQ ID NO: 1169 - DNA, 20 bp, Artificial sequence
  Synthetic oligonucleotide
tgggcttcataacaccagcc

SEQ ID NO: 1170 - DNA, 20 bp, Artificial sequence
  Synthetic oligonucleotide
tgcacatatcaccaacgacc

SEQ ID NO: 1171 - DNA, 20 bp, Artificial sequence
  Synthetic oligonucleotide
atggaagtctcacatctggt

SEQ ID NO: 1172 - DNA, 20 bp, Artificial sequence
  Synthetic oligonucleotide
atcctctcattgtactgcat

SEQ ID NO: 1173 - DNA, 20 bp, Artificial sequence
  Synthetic oligonucleotide
tctccaattttaacttgcac

SEQ ID NO: 1174 - DNA, 20 bp, Artificial sequence
  Synthetic oligonucleotide
gtgatttaccattttcaggc

SEQ ID NO: 1175 - DNA, 20 bp, Artificial sequence
  Synthetic oligonucleotide
ttggtaaatatccactggac

SEQ ID NO: 1176 - DNA, 20 bp, Artificial sequence
  Synthetic oligonucleotide
taaatcataaaacgggtttg

SEQ ID NO: 1177 - DNA, 20 bp, Artificial sequence
  Synthetic oligonucleotide
tgcttcatacatcctctaac

SEQ ID NO: 1178 - DNA, 20 bp, Artificial sequence
  Synthetic oligonucleotide
cgcatatattttattacacc

SEQ ID NO: 1179 - DNA, 20 bp, Artificial sequence
  Synthetic oligonucleotide
gtccttccctgctacaggca

SEQ ID NO: 1180 - DNA, 20 bp, Artificial sequence
  Synthetic oligonucleotide
ggtttccctttatttggact

SEQ ID NO: 1181 - DNA, 20 bp, Artificial sequence
  Synthetic oligonucleotide
tgatttcactaaccggcaaa

SEQ ID NO: 1182 - DNA, 20 bp, Artificial sequence
  Synthetic oligonucleotide
ttgatgttgaatttcttaca

SEQ ID NO: 1183 - DNA, 20 bp, Artificial sequence
  Synthetic oligonucleotide
cactgcatgtctctttggcg

SEQ ID NO: 1184 - DNA, 20 bp, Artificial sequence
  Synthetic oligonucleotide
gcagcatcccaccagtgtat

SEQ ID NO: 1185 - DNA, 20 bp, Artificial sequence
  Synthetic oligonucleotide
gccatctctctatagttata

SEQ ID NO: 1186 - DNA, 20 bp, Artificial sequence
  Synthetic oligonucleotide
ttgcctctttttgactgcac

SEQ ID NO: 1187 - DNA, 20 bp, Artificial sequence
  Synthetic oligonucleotide
atgtaagctactcttctacc

SEQ ID NO: 1188 - DNA, 20 bp, Artificial sequence
  Synthetic oligonucleotide
ttcccttcttacaattatgc

SEQ ID NO: 1189 - DNA, 20 bp, Artificial sequence
  Synthetic oligonucleotide
ccggcctttttgattactct

SEQ ID NO: 1190 - DNA, 20 bp, Artificial sequence
  Synthetic oligonucleotide
gcatgcttataccactaagt

SEQ ID NO: 1191 - DNA, 20 bp, Artificial sequence
  Synthetic oligonucleotide
tgcttgcactcttatctttc

SEQ ID NO: 1192 - DNA, 20 bp, Artificial sequence
  Synthetic oligonucleotide
gctatgagttcacaaagctc

SEQ ID NO: 1193 - DNA, 20 bp, Artificial sequence
  Synthetic oligonucleotide
gtggttttattactaggatt

SEQ ID NO: 1194 - DNA, 20 bp, Artificial sequence
  Synthetic oligonucleotide
tgcataccatcttcagattc

SEQ ID NO: 1195 - DNA, 20 bp, Artificial sequence
  Synthetic oligonucleotide
tgctggcccaaattccatcc

SEQ ID NO: 1196 - DNA, 20 bp, Artificial sequence
  Synthetic oligonucleotide
caggaatcatcaatgcaggc

SEQ ID NO: 1197 - DNA, 20 bp, Artificial sequence
  Synthetic oligonucleotide
acgccaacttctctgcaaca

SEQ ID NO: 1198 - DNA, 20 bp, Artificial sequence
  Synthetic oligonucleotide
ttcaccacataacatcagga

SEQ ID NO: 1199 - DNA, 20 bp, Artificial sequence
  Synthetic oligonucleotide
ccactccatacatttgcatc

SEQ ID NO: 1200 - DNA, 20 bp, Artificial sequence
  Synthetic oligonucleotide
tggcatcctctcattgtact

SEQ ID NO: 1201 - DNA, 20 bp, Artificial sequence
  Synthetic oligonucleotide
gttctccaattttaacttgc

SEQ ID NO: 1202 - DNA, 20 bp, Artificial sequence
  Synthetic oligonucleotide
aatactgctcctatagggtc

SEQ ID NO: 1203 - DNA, 20 bp, Artificial sequence
  Synthetic oligonucleotide
aggctgaactctccattcac

SEQ ID NO: 1204 - DNA, 20 bp, Artificial sequence
  Synthetic oligonucleotide
atgtactaccttctcctcca

SEQ ID NO: 1205 - DNA, 20 bp, Artificial sequence
  Synthetic oligonucleotide
tacctcacacaacacctggc

SEQ ID NO: 1206 - DNA, 20 bp, Artificial sequence
  Synthetic oligonucleotide
ccacactatatacataacct

SEQ ID NO: 1207 - DNA, 20 bp, Artificial sequence
  Synthetic oligonucleotide
ctggaccctacatcatctca

SEQ ID NO: 1208 - DNA, 20 bp, Artificial sequence
  Synthetic oligonucleotide
ccacactggatccttcatct

SEQ ID NO: 1209 - DNA, 20 bp, Artificial sequence
  Synthetic oligonucleotide
cacaaactactttccctgga

SEQ ID NO: 1210 - DNA, 20 bp, Artificial sequence
  Synthetic oligonucleotide
gctgattacttccttgtatc

SEQ ID NO: 1211 - DNA, 20 bp, Artificial sequence
  Synthetic oligonucleotide
gcattcagcgcactattctc

SEQ ID NO: 1212 - DNA, 20 bp, Artificial sequence
  Synthetic oligonucleotide
tccacagtccctcatcctct

SEQ ID NO: 1213 - DNA, 20 bp, Artificial sequence
  Synthetic oligonucleotide
gtgatttcactaaccggcaa

SEQ ID NO: 1214 - DNA, 20 bp, Artificial sequence
  Synthetic oligonucleotide
cctttcacttagcattccca

SEQ ID NO: 1215 - DNA, 20 bp, Artificial sequence
  Synthetic oligonucleotide
cagaacctgtattacatcat

SEQ ID NO: 1216 - DNA, 20 bp, Artificial sequence
  Synthetic oligonucleotide
cagccaaatactcacatggc

SEQ ID NO: 1217 - DNA, 20 bp, Artificial sequence
  Synthetic oligonucleotide
ttgcatgcttataccactaa

SEQ ID NO: 1218 - DNA, 20 bp, Artificial sequence
  Synthetic oligonucleotide
acatctattctctattcagc

SEQ ID NO: 1219 - DNA, 20 bp, Artificial sequence
  Synthetic oligonucleotide
atgccatctctctatagtta

SEQ ID NO: 1220 - DNA, 20 bp, Artificial sequence
  Synthetic oligonucleotide
gtacctaattcacaatagta

SEQ ID NO: 1221 - DNA, 20 bp, Artificial sequence
  Synthetic oligonucleotide
accaacatcgcctcacttcc

SEQ ID NO: 1222 - DNA, 20 bp, Artificial sequence
  Synthetic oligonucleotide
gtcctagctattaccattgc

SEQ ID NO: 1223 - DNA, 20 bp, Artificial sequence
  Synthetic oligonucleotide
gcagctacctccagctggtc

SEQ ID NO: 1224 - DNA, 20 bp, Artificial sequence
  Synthetic oligonucleotide
tacctcccatctgcatagtc

SEQ ID NO: 1225 - DNA, 20 bp, Artificial sequence
  Synthetic oligonucleotide
gctgccacattccaaagcaa

SEQ ID NO: 1226 - DNA, 20 bp, Artificial sequence
  Synthetic oligonucleotide
tctcatttaatactgccatt

SEQ ID NO: 1227 - DNA, 20 bp, Artificial sequence
  Synthetic oligonucleotide
aaaggtgcaacttttcaagc

SEQ ID NO: 1228 - DNA, 20 bp, Artificial sequence
  Synthetic oligonucleotide
gcaagagatattattccctt

SEQ ID NO: 1229 - DNA, 20 bp, Artificial sequence
  Synthetic oligonucleotide
tgccaacctaataccaagct

SEQ ID NO: 1230 - DNA, 20 bp, Artificial sequence
  Synthetic oligonucleotide
gctgtgttttaacccagaac

SEQ ID NO: 1231 - DNA, 20 bp, Artificial sequence
  Synthetic oligonucleotide
gtaaatcataaaacgggttt

SEQ ID NO: 1232 - DNA, 20 bp, Artificial sequence
  Synthetic oligonucleotide
gccagccaatatccttgtac

SEQ ID NO: 1233 - DNA, 20 bp, Artificial sequence
  Synthetic oligonucleotide
gcatattaacaataatgggc

SEQ ID NO: 1234 - DNA, 20 bp, Artificial sequence
  Synthetic oligonucleotide
cggtgaacacatctatgcct

SEQ ID NO: 1235 - DNA, 20 bp, Artificial sequence
  Synthetic oligonucleotide
tcactgcatgtctctttggc

SEQ ID NO: 1236 - DNA, 20 bp, Artificial sequence
  Synthetic oligonucleotide
tcatcatcatttaaccacag

SEQ ID NO: 1237 - DNA, 20 bp, Artificial sequence
  Synthetic oligonucleotide
atcctatattcataccaacc

SEQ ID NO: 1238 - DNA, 20 bp, Artificial sequence
  Synthetic oligonucleotide
ccagttgccactcaatatcc

SEQ ID NO: 1239 - DNA, 20 bp, Artificial sequence
  Synthetic oligonucleotide
tggtttccctttatttggac

SEQ ID NO: 1240 - DNA, 20 bp, Artificial sequence
  Synthetic oligonucleotide
gcagtactaatagccttgca

SEQ ID NO: 1241 - DNA, 20 bp, Artificial sequence
  Synthetic oligonucleotide
ctgcacatatcaccaacgac

SEQ ID NO: 1242 - DNA, 20 bp, Artificial sequence
  Synthetic oligonucleotide
atgtgcttcttccaacaccc

SEQ ID NO: 1243 - DNA, 20 bp, Artificial sequence
  Synthetic oligonucleotide
gcagacaatttttttagaac

SEQ ID NO: 1244 - DNA, 20 bp, Artificial sequence
  Synthetic oligonucleotide
gtctacttcctactggaatc

SEQ ID NO: 1245 - DNA, 20 bp, Artificial sequence
  Synthetic oligonucleotide
ccactcttacttgactcatc

SEQ ID NO: 1246 - DNA, 20 bp, Artificial sequence
  Synthetic oligonucleotide
ttgacttttttctattatcc

SEQ ID NO: 1247 - DNA, 20 bp, Artificial sequence
  Synthetic oligonucleotide
tcagtatattctctgcccaa

SEQ ID NO: 1248 - DNA, 20 bp, Artificial sequence
  Synthetic oligonucleotide
tcgagatacttgtcaacggc

SEQ ID NO: 1249 - DNA, 20 bp, Artificial sequence
  Synthetic oligonucleotide
atctaagtttaccttcacat

SEQ ID NO: 1250 - DNA, 20 bp, Artificial sequence
  Synthetic oligonucleotide
ctgcttcatacatcctctaa

SEQ ID NO: 1251 - DNA, 20 bp, Artificial sequence
  Synthetic oligonucleotide
taggcttctctccatttctc

SEQ ID NO: 1252 - DNA, 20 bp, Artificial sequence
  Synthetic oligonucleotide
ttgccattatacccccacaa

SEQ ID NO: 1253 - DNA, 20 bp, Artificial sequence
  Synthetic oligonucleotide
ggacactgcacctccctgac

SEQ ID NO: 1254 - DNA, 20 bp, Artificial sequence
  Synthetic oligonucleotide
gcgcatatattttattacac

SEQ ID NO: 1255 - DNA, 20 bp, Artificial sequence
  Synthetic oligonucleotide
ttcctcttagatcctgggct

SEQ ID NO: 1256 - DNA, 20 bp, Artificial sequence
  Synthetic oligonucleotide
ggcttctaacaatttcagca

SEQ ID NO: 1257 - DNA, 20 bp, Artificial sequence
  Synthetic oligonucleotide
gcaacttcatcttttcctgc

SEQ ID NO: 1258 - DNA, 20 bp, Artificial sequence
  Synthetic oligonucleotide
accaaggactttcagtccca

SEQ ID NO: 1259 - DNA, 20 bp, Artificial sequence
  Synthetic oligonucleotide
ccacaatcctttattgatgt

SEQ ID NO: 1260 - DNA, 20 bp, Artificial sequence
  Synthetic oligonucleotide
ttcctcattaaccaacccaa

SEQ ID NO: 1261 - DNA, 20 bp, Artificial sequence
  Synthetic oligonucleotide
atgtgctcacactctgatct

SEQ ID NO: 1262 - DNA, 20 bp, Artificial sequence
  Synthetic oligonucleotide
tctcctgtatgactctcctc

SEQ ID NO: 1263 - DNA, 20 bp, Artificial sequence
  Synthetic oligonucleotide
tggcatcaaattcaacatta

SEQ ID NO: 1264 - DNA, 20 bp, Artificial sequence
  Synthetic oligonucleotide
gtttgtcctatttattcctc

SEQ ID NO: 1265 - DNA, 20 bp, Artificial sequence
  Synthetic oligonucleotide
gcttcttgtcacaatctcta

SEQ ID NO: 1266 - DNA, 20 bp, Artificial sequence
  Synthetic oligonucleotide
acagaatctctttattgtca

SEQ ID NO: 1267 - DNA, 20 bp, Artificial sequence
  Synthetic oligonucleotide
agtggttctccaacagggta

SEQ ID NO: 1268 - DNA, 20 bp, Artificial sequence
  Synthetic oligonucleotide
gttccttccattccaagtaa

SEQ ID NO: 1269 - DNA, 20 bp, Artificial sequence
  Synthetic oligonucleotide
cttacctcccatctgcatag

SEQ ID NO: 1270 - DNA, 20 bp, Artificial sequence
  Synthetic oligonucleotide
tgtacagatatttttctgga

SEQ ID NO: 1271 - DNA, 20 bp, Artificial sequence
  Synthetic oligonucleotide
ttcagtatattctctgccca

SEQ ID NO: 1272 - DNA, 20 bp, Artificial sequence
  Synthetic oligonucleotide
tttcaatatacaccctgggt

SEQ ID NO: 1273 - DNA, 20 bp, Artificial sequence
  Synthetic oligonucleotide
tccttaatttcatttcagta

SEQ ID NO: 1274 - DNA, 20 bp, Artificial sequence
  Synthetic oligonucleotide
gacttgtttttcaccacata

SEQ ID NO: 1275 - DNA, 20 bp, Artificial sequence
  Synthetic oligonucleotide
acactagtctcacccatgtt

SEQ ID NO: 1276 - DNA, 20 bp, Artificial sequence
  Synthetic oligonucleotide
ttgatgtttttcacggcctc

SEQ ID NO: 1277 - DNA, 20 bp, Artificial sequence
  Synthetic oligonucleotide
agttccttcccccagttatc

SEQ ID NO: 1278 - DNA, 20 bp, Artificial sequence
  Synthetic oligonucleotide
ctgagttgctccttctgaac

SEQ ID NO: 1279 - DNA, 20 bp, Artificial sequence
  Synthetic oligonucleotide
tccgcagtactaatagcctt

SEQ ID NO: 1280 - DNA, 20 bp, Artificial sequence
  Synthetic oligonucleotide
cagctcttttctccgttctc

SEQ ID NO: 1281 - DNA, 20 bp, Artificial sequence
  Synthetic oligonucleotide
gcttttccattacattcctc

SEQ ID NO: 1282 - DNA, 20 bp, Artificial sequence
  Synthetic oligonucleotide
gttaaggccacctctgtcca

SEQ ID NO: 1283 - DNA, 20 bp, Artificial sequence
  Synthetic oligonucleotide
gcagcagcatagacttgggt

SEQ ID NO: 1284 - DNA, 20 bp, Artificial sequence
  Synthetic oligonucleotide
tgctgatctcatttaatact

SEQ ID NO: 1285 - DNA, 20 bp, Artificial sequence
  Synthetic oligonucleotide
agtaaatcataaaacgggtt

SEQ ID NO: 1286 - DNA, 20 bp, Artificial sequence
  Synthetic oligonucleotide
gccacactatatacataacc

SEQ ID NO: 1287 - DNA, 20 bp, Artificial sequence
  Synthetic oligonucleotide
aggcattacaatattgctat

SEQ ID NO: 1288 - DNA, 20 bp, Artificial sequence
  Synthetic oligonucleotide
ctcactgcatgtctctttgg

SEQ ID NO: 1289 - DNA, 20 bp, Artificial sequence
  Synthetic oligonucleotide
ctcgagatacttgtcaacgg

SEQ ID NO: 1290 - DNA, 20 bp, Artificial sequence
  Synthetic oligonucleotide
ttccaaatttaaccttgtct

SEQ ID NO: 1291 - DNA, 20 bp, Artificial sequence
  Synthetic oligonucleotide
gttcatcatcatttaaccac

SEQ ID NO: 1292 - DNA, 20 bp, Artificial sequence
  Synthetic oligonucleotide
tgacatactttccccatgca

SEQ ID NO: 1293 - DNA, 20 bp, Artificial sequence
  Synthetic oligonucleotide
ggcttattcatcttttccct

SEQ ID NO: 1294 - DNA, 20 bp, Artificial sequence
  Synthetic oligonucleotide
gtgctcaaaatctaatgttt

SEQ ID NO: 1295 - DNA, 20 bp, Artificial sequence
  Synthetic oligonucleotide
aggatgattttcaacatcca

SEQ ID NO: 1296 - DNA, 20 bp, Artificial sequence
  Synthetic oligonucleotide
tgtgatttcactaaccggca

SEQ ID NO: 1297 - DNA, 20 bp, Artificial sequence
  Synthetic oligonucleotide
gtatacatctaactgcctgc

SEQ ID NO: 1298 - DNA, 20 bp, Artificial sequence
  Synthetic oligonucleotide
gcgcttttactctatcaata

SEQ ID NO: 1299 - DNA, 20 bp, Artificial sequence
  Synthetic oligonucleotide
actggaccctacatcatctc

SEQ ID NO: 1300 - DNA, 20 bp, Artificial sequence
  Synthetic oligonucleotide
gtggcatcctctcattgtac

SEQ ID NO: 1301 - DNA, 20 bp, Artificial sequence
  Synthetic oligonucleotide
agtctttgcccatcagggtt

SEQ ID NO: 1302 - DNA, 20 bp, Artificial sequence
  Synthetic oligonucleotide
gcacacacactcatcactgc

SEQ ID NO: 1303 - DNA, 20 bp, Artificial sequence
  Synthetic oligonucleotide
aggtctcctcctattgcccc

SEQ ID NO: 1304 - DNA, 20 bp, Artificial sequence
  Synthetic oligonucleotide
ttgcataccatcttcagatt

SEQ ID NO: 1305 - DNA, 20 bp, Artificial sequence
  Synthetic oligonucleotide
ccaactttttgaattatgta

SEQ ID NO: 1306 - DNA, 20 bp, Artificial sequence
  Synthetic oligonucleotide
tgctgattacttccttgtat

SEQ ID NO: 1307 - DNA, 20 bp, Artificial sequence
  Synthetic oligonucleotide
cgtccaggctgaactctcca

SEQ ID NO: 1308 - DNA, 20 bp, Artificial sequence
  Synthetic oligonucleotide
gcttgccattatacccccac

SEQ ID NO: 1309 - DNA, 20 bp, Artificial sequence
  Synthetic oligonucleotide
gccattttttgataaggaac

SEQ ID NO: 1310 - DNA, 20 bp, Artificial sequence
  Synthetic oligonucleotide
ctggtttccctttatttgga

SEQ ID NO: 1311 - DNA, 20 bp, Artificial sequence
  Synthetic oligonucleotide
atccactcttacttgactca

SEQ ID NO: 1312 - DNA, 20 bp, Artificial sequence
  Synthetic oligonucleotide
gtcaacccagaacctgtatt

SEQ ID NO: 1313 - DNA, 20 bp, Artificial sequence
  Synthetic oligonucleotide
ggagaacactatcaatgcat

SEQ ID NO: 1314 - DNA, 20 bp, Artificial sequence
  Synthetic oligonucleotide
gctcccattttatatttaac

SEQ ID NO: 1315 - DNA, 20 bp, Artificial sequence
  Synthetic oligonucleotide
tggtacctcacacaacacct

SEQ ID NO: 1316 - DNA, 20 bp, Artificial sequence
  Synthetic oligonucleotide
gcttataactctcatactgt

SEQ ID NO: 1317 - DNA, 20 bp, Artificial sequence
  Synthetic oligonucleotide
ctggcatcaaattcaacatt

SEQ ID NO: 1318 - DNA, 20 bp, Artificial sequence
  Synthetic oligonucleotide
attgcatgcttataccacta

SEQ ID NO: 1319 - DNA, 20 bp, Artificial sequence
  Synthetic oligonucleotide
gcatacccattctgacactt

SEQ ID NO: 1320 - DNA, 20 bp, Artificial sequence
  Synthetic oligonucleotide
tgggtttcattctcagtgct

SEQ ID NO: 1321 - DNA, 20 bp, Artificial sequence
  Synthetic oligonucleotide
tggtactgtatttcttctac

SEQ ID NO: 1322 - DNA, 20 bp, Artificial sequence
  Synthetic oligonucleotide
tggtaattaattttctgtgc

SEQ ID NO: 1323 - DNA, 20 bp, Artificial sequence
  Synthetic oligonucleotide
actggctcacctgcctgcca

SEQ ID NO: 1324 - DNA, 20 bp, Artificial sequence
  Synthetic oligonucleotide
cctgtcctcacactattctt

SEQ ID NO: 1325 - DNA, 20 bp, Artificial sequence
  Synthetic oligonucleotide
atacttccttgttttacgct

SEQ ID NO: 1326 - DNA, 20 bp, Artificial sequence
  Synthetic oligonucleotide
gctggtgtctcctctcccaa

SEQ ID NO: 1327 - DNA, 20 bp, Artificial sequence
  Synthetic oligonucleotide
cccacatcttcttctcattc

SEQ ID NO: 1328 - DNA, 20 bp, Artificial sequence
  Synthetic oligonucleotide
ctgacctttcacttagcatt

SEQ ID NO: 1329 - DNA, 20 bp, Artificial sequence
  Synthetic oligonucleotide
aagacatctttatttgctca

SEQ ID NO: 1330 - DNA, 20 bp, Artificial sequence
  Synthetic oligonucleotide
tggttctccaattttaactt

SEQ ID NO: 1331 - DNA, 20 bp, Artificial sequence
  Synthetic oligonucleotide
atgccagccaatatccttgt

SEQ ID NO: 1332 - DNA, 20 bp, Artificial sequence
  Synthetic oligonucleotide
cctgcttcatacatcctcta

SEQ ID NO: 1333 - DNA, 20 bp, Artificial sequence
  Synthetic oligonucleotide
ggccatccatcttccccact

SEQ ID NO: 1334 - DNA, 20 bp, Artificial sequence
  Synthetic oligonucleotide
tctgtctacttcctactgga

SEQ ID NO: 1335 - DNA, 20 bp, Artificial sequence
  Synthetic oligonucleotide
gctgccctttatataagctt

SEQ ID NO: 1336 - DNA, 20 bp, Artificial sequence
  Synthetic oligonucleotide
atgcttgcactcttatcttt

SEQ ID NO: 1337 - DNA, 20 bp, Artificial sequence
  Synthetic oligonucleotide
tgtgtcgactttcaagtctt

SEQ ID NO: 1338 - DNA, 20 bp, Artificial sequence
  Synthetic oligonucleotide
ttgtaggattttcttggcac

SEQ ID NO: 1339 - DNA, 20 bp, Artificial sequence
  Synthetic oligonucleotide
ctgacatgtacacctctcca

SEQ ID NO: 1340 - DNA, 20 bp, Artificial sequence
  Synthetic oligonucleotide
ggtgctctatcacccagtaa

SEQ ID NO: 1341 - DNA, 20 bp, Artificial sequence
  Synthetic oligonucleotide
gaccaacatcgcctcacttc

SEQ ID NO: 1342 - DNA, 20 bp, Artificial sequence
  Synthetic oligonucleotide
ccgttcccactctacacaga

SEQ ID NO: 1343 - DNA, 20 bp, Artificial sequence
  Synthetic oligonucleotide
cccactccatacatttgcat

SEQ ID NO: 1344 - DNA, 20 bp, Artificial sequence
  Synthetic oligonucleotide
tcatgtgcttcttccaacac

SEQ ID NO: 1345 - DNA, 20 bp, Artificial sequence
  Synthetic oligonucleotide
tgttaaggccacctctgtcc

SEQ ID NO: 1346 - DNA, 20 bp, Artificial sequence
  Synthetic oligonucleotide
gtgcaagacataccagacac

SEQ ID NO: 1347 - DNA, 20 bp, Artificial sequence
  Synthetic oligonucleotide
tgcttgccattataccccca

SEQ ID NO: 1348 - DNA, 20 bp, Artificial sequence
  Synthetic oligonucleotide
aggcagtgatctctaacctt

SEQ ID NO: 1349 - DNA, 20 bp, Artificial sequence
  Synthetic oligonucleotide
cggcagtttaaaattctctt

SEQ ID NO: 1350 - DNA, 20 bp, Artificial sequence
  Synthetic oligonucleotide
tccacctccactatcttcat

SEQ ID NO: 1351 - DNA, 20 bp, Artificial sequence
  Synthetic oligonucleotide
agccacactatatacataac

SEQ ID NO: 1352 - DNA, 20 bp, Artificial sequence
  Synthetic oligonucleotide
ccatgatgcttatttgtgta

SEQ ID NO: 1353 - DNA, 20 bp, Artificial sequence
  Synthetic oligonucleotide
gcgacagtcaccatgccagc

SEQ ID NO: 1354 - DNA, 20 bp, Artificial sequence
  Synthetic oligonucleotide
gtccaagtttattcaataca

SEQ ID NO: 1355 - DNA, 20 bp, Artificial sequence
  Synthetic oligonucleotide
caggcattacaatattgcta

SEQ ID NO: 1356 - DNA, 20 bp, Artificial sequence
  Synthetic oligonucleotide
ccttcttcatacattattct

SEQ ID NO: 1357 - DNA, 20 bp, Artificial sequence
  Synthetic oligonucleotide
tcctgcttcatacatcctct

SEQ ID NO: 1358 - DNA, 20 bp, Artificial sequence
  Synthetic oligonucleotide
caggcttattcatcttttcc

SEQ ID NO: 1359 - DNA, 20 bp, Artificial sequence
  Synthetic oligonucleotide
aaggatgattttcaacatcc

SEQ ID NO: 1360 - DNA, 20 bp, Artificial sequence
  Synthetic oligonucleotide
gccctgtcctcacactattc

SEQ ID NO: 1361 - DNA, 20 bp, Artificial sequence
  Synthetic oligonucleotide
ctgtagaattcaccatccac

SEQ ID NO: 1362 - DNA, 20 bp, Artificial sequence
  Synthetic oligonucleotide
ggttgatcctaatccactat

SEQ ID NO: 1363 - DNA, 20 bp, Artificial sequence
  Synthetic oligonucleotide
ctgacatactttccccatgc

SEQ ID NO: 1364 - DNA, 20 bp, Artificial sequence
  Synthetic oligonucleotide
gcagagctttccgagtgcca

SEQ ID NO: 1365 - DNA, 20 bp, Artificial sequence
  Synthetic oligonucleotide
cccatgtgaattctttggga

SEQ ID NO: 1366 - DNA, 20 bp, Artificial sequence
  Synthetic oligonucleotide
gatcactggaccctacatca

SEQ ID NO: 1367 - DNA, 20 bp, Artificial sequence
  Synthetic oligonucleotide
taccgtctcttttctggtca

SEQ ID NO: 1368 - DNA, 20 bp, Artificial sequence
  Synthetic oligonucleotide
aatgtgatttcactaaccgg

SEQ ID NO: 1369 - DNA, 20 bp, Artificial sequence
  Synthetic oligonucleotide
tgctgccctttatataagct

SEQ ID NO: 1370 - DNA, 20 bp, Artificial sequence
  Synthetic oligonucleotide
attggcctaacatcacgcct

SEQ ID NO: 1371 - DNA, 20 bp, Artificial sequence
  Synthetic oligonucleotide
gccacatctattcacagcca

SEQ ID NO: 1372 - DNA, 20 bp, Artificial sequence
  Synthetic oligonucleotide
ccagtattttttacccagca

SEQ ID NO: 1373 - DNA, 20 bp, Artificial sequence
  Synthetic oligonucleotide
acccacatcttcttctcatt

SEQ ID NO: 1374 - DNA, 20 bp, Artificial sequence
  Synthetic oligonucleotide
ctttgtttgaacccacatct

SEQ ID NO: 1375 - DNA, 20 bp, Artificial sequence
  Synthetic oligonucleotide
ctcatgtgcttcttccaaca

SEQ ID NO: 1376 - DNA, 20 bp, Artificial sequence
  Synthetic oligonucleotide
gttgcataccatcttcagat

SEQ ID NO: 1377 - DNA, 20 bp, Artificial sequence
  Synthetic oligonucleotide
ggttatttcttccaaagctc

SEQ ID NO: 1378 - DNA, 20 bp, Artificial sequence
  Synthetic oligonucleotide
cagcacacacactcatcact

SEQ ID NO: 1379 - DNA, 20 bp, Artificial sequence
  Synthetic oligonucleotide
tcactattattaactagtca

SEQ ID NO: 1380 - DNA, 20 bp, Artificial sequence
  Synthetic oligonucleotide
catccattccacatggccta

SEQ ID NO: 1381 - DNA, 20 bp, Artificial sequence
  Synthetic oligonucleotide
tgtgcttataactctcatac

SEQ ID NO: 1382 - DNA, 20 bp, Artificial sequence
  Synthetic oligonucleotide
ccagctcttttctccgttct

SEQ ID NO: 1383 - DNA, 20 bp, Artificial sequence
  Synthetic oligonucleotide
ccggaactctgtcttgggta

SEQ ID NO: 1384 - DNA, 20 bp, Artificial sequence
  Synthetic oligonucleotide
actctttcaattctgacctt

SEQ ID NO: 1385 - DNA, 20 bp, Artificial sequence
  Synthetic oligonucleotide
tgaatgtctgtctacttcct

SEQ ID NO: 1386 - DNA, 20 bp, Artificial sequence
  Synthetic oligonucleotide
tggcaagcctttttagtctt

SEQ ID NO: 1387 - DNA, 20 bp, Artificial sequence
  Synthetic oligonucleotide
gtcttttccaacaattggca

SEQ ID NO: 1388 - DNA, 20 bp, Artificial sequence
  Synthetic oligonucleotide
gctaccttgtccaactggtt

SEQ ID NO: 1389 - DNA, 20 bp, Artificial sequence
  Synthetic oligonucleotide
tgccgttcccactctacaca

SEQ ID NO: 1390 - DNA, 20 bp, Artificial sequence
  Synthetic oligonucleotide
taggcatttttcattcagga

SEQ ID NO: 1391 - DNA, 20 bp, Artificial sequence
  Synthetic oligonucleotide
tggtgctctatcacccagta

SEQ ID NO: 1392 - DNA, 20 bp, Artificial sequence
  Synthetic oligonucleotide
tcactcctcatacctgcaca

SEQ ID NO: 1393 - DNA, 20 bp, Artificial sequence
  Synthetic oligonucleotide
agtctcctcactgcttgcta

SEQ ID NO: 1394 - DNA, 20 bp, Artificial sequence
  Synthetic oligonucleotide
tgtggcatcctctcattgta

SEQ ID NO: 1395 - DNA, 20 bp, Artificial sequence
  Synthetic oligonucleotide
caacaagcccactttcttgc

SEQ ID NO: 1396 - DNA, 20 bp, Artificial sequence
  Synthetic oligonucleotide
gccacagtattaaatttgtt

SEQ ID NO: 1397 - DNA, 20 bp, Artificial sequence
  Synthetic oligonucleotide
ttctcactgcatgtctcttt

SEQ ID NO: 1398 - DNA, 20 bp, Artificial sequence
  Synthetic oligonucleotide
gcctattaatgacatgtgca

SEQ ID NO: 1399 - DNA, 20 bp, Artificial sequence
  Synthetic oligonucleotide
gcttcgatacctctgcctta

SEQ ID NO: 1400 - DNA, 20 bp, Artificial sequence
  Synthetic oligonucleotide
tctgcatcaatagcagggtt

SEQ ID NO: 1401 - DNA, 20 bp, Artificial sequence
  Synthetic oligonucleotide
cctctatccctttatggtac

SEQ ID NO: 1402 - DNA, 20 bp, Artificial sequence
  Synthetic oligonucleotide
catctagtaacttctccgca

SEQ ID NO: 1403 - DNA, 20 bp, Artificial sequence
  Synthetic oligonucleotide
ctgacactagtctcacccat

SEQ ID NO: 1404 - DNA, 20 bp, Artificial sequence
  Synthetic oligonucleotide
ccatcatctgacctttccaa

SEQ ID NO: 1405 - DNA, 20 bp, Artificial sequence
  Synthetic oligonucleotide
tcccattcttccttctggcc

SEQ ID NO: 1406 - DNA, 20 bp, Artificial sequence
  Synthetic oligonucleotide
tgagtaaatcataaaacggg

SEQ ID NO: 1407 - DNA, 20 bp, Artificial sequence
  Synthetic oligonucleotide
tgtcaacccagaacctgtat

SEQ ID NO: 1408 - DNA, 20 bp, Artificial sequence
  Synthetic oligonucleotide
gtctacaattattcttttac

SEQ ID NO: 1409 - DNA, 20 bp, Artificial sequence
  Synthetic oligonucleotide
ccccactccatacatttgca

SEQ ID NO: 1410 - DNA, 20 bp, Artificial sequence
  Synthetic oligonucleotide
cttcatgacacctcttgcat

SEQ ID NO: 1411 - DNA, 20 bp, Artificial sequence
  Synthetic oligonucleotide
tggcatggcttcaactggct

SEQ ID NO: 1412 - DNA, 20 bp, Artificial sequence
  Synthetic oligonucleotide
aaggtatacatctaactgcc

SEQ ID NO: 1413 - DNA, 20 bp, Artificial sequence
  Synthetic oligonucleotide
cggccatccatcttccccac

SEQ ID NO: 1414 - DNA, 20 bp, Artificial sequence
  Synthetic oligonucleotide
tctcgagatacttgtcaacg

SEQ ID NO: 1415 - DNA, 20 bp, Artificial sequence
  Synthetic oligonucleotide
gtgctgattacttccttgta

SEQ ID NO: 1416 - DNA, 20 bp, Artificial sequence
  Synthetic oligonucleotide
gtcatcttctcatcttaact

SEQ ID NO: 1417 - DNA, 20 bp, Artificial sequence
  Synthetic oligonucleotide
catgcttgcactcttatctt

SEQ ID NO: 1418 - DNA, 20 bp, Artificial sequence
  Synthetic oligonucleotide
gctcatttcacatcagacac

SEQ ID NO: 1419 - DNA, 20 bp, Artificial sequence
  Synthetic oligonucleotide
gccaaactcctactgactgc

SEQ ID NO: 1420 - DNA, 20 bp, Artificial sequence
  Synthetic oligonucleotide
ccacatttcacccacctcca

SEQ ID NO: 1421 - DNA, 20 bp, Artificial sequence
  Synthetic oligonucleotide
ttagtctcactgtcttggct

SEQ ID NO: 1422 - DNA, 20 bp, Artificial sequence
  Synthetic oligonucleotide
gtctcgagatacttgtcaac

SEQ ID NO: 1423 - DNA, 20 bp, Artificial sequence
  Synthetic oligonucleotide
ttggctttaccatagagcta

SEQ ID NO: 1424 - DNA, 20 bp, Artificial sequence
  Synthetic oligonucleotide
gggttatttcttccaaagct

SEQ ID NO: 1425 - DNA, 20 bp, Artificial sequence
  Synthetic oligonucleotide
ggacatttcttctatctacc

SEQ ID NO: 1426 - DNA, 20 bp, Artificial sequence
  Synthetic oligonucleotide
gccacttcaactgaagtcac

SEQ ID NO: 1427 - DNA, 20 bp, Artificial sequence
  Synthetic oligonucleotide
ttggttcatttctttagcca

SEQ ID NO: 1428 - DNA, 20 bp, Artificial sequence
  Synthetic oligonucleotide
cagcttcgatacctctgcct

SEQ ID NO: 1429 - DNA, 20 bp, Artificial sequence
  Synthetic oligonucleotide
tgtttctttacccacatctt

SEQ ID NO: 1430 - DNA, 20 bp, Artificial sequence
  Synthetic oligonucleotide
acctttgtttgaacccacat

SEQ ID NO: 1431 - DNA, 20 bp, Artificial sequence
  Synthetic oligonucleotide
tcttctgtctacaattattc

SEQ ID NO: 1432 - DNA, 20 bp, Artificial sequence
  Synthetic oligonucleotide
cctcagcacacacactcatc

SEQ ID NO: 1433 - DNA, 20 bp, Artificial sequence
  Synthetic oligonucleotide
tgtccttcatgacacctctt

SEQ ID NO: 1434 - DNA, 20 bp, Artificial sequence
  Synthetic oligonucleotide
gggttagtctcctttcatca

SEQ ID NO: 1435 - DNA, 20 bp, Artificial sequence
  Synthetic oligonucleotide
gtgtgcttataactctcata

SEQ ID NO: 1436 - DNA, 20 bp, Artificial sequence
  Synthetic oligonucleotide
tcatgcttgcactcttatct

SEQ ID NO: 1437 - DNA, 20 bp, Artificial sequence
  Synthetic oligonucleotide
aggaccagtattattccatc

SEQ ID NO: 1438 - DNA, 20 bp, Artificial sequence
  Synthetic oligonucleotide
gtgcactgtaactttatcca

SEQ ID NO: 1439 - DNA, 20 bp, Artificial sequence
  Synthetic oligonucleotide
tgtgaacccacttcttgtct

SEQ ID NO: 1440 - DNA, 20 bp, Artificial sequence
  Synthetic oligonucleotide
cagttttttccccaatccaa

SEQ ID NO: 1441 - DNA, 20 bp, Artificial sequence
  Synthetic oligonucleotide
ctagttgttatttaccggca

SEQ ID NO: 1442 - DNA, 20 bp, Artificial sequence
  Synthetic oligonucleotide
ctccaacttttccaagtgca

SEQ ID NO: 1443 - DNA, 20 bp, Artificial sequence
  Synthetic oligonucleotide
cattctatttggtgctctat

SEQ ID NO: 1444 - DNA, 20 bp, Artificial sequence
  Synthetic oligonucleotide
cctttaccctgacactagtc

SEQ ID NO: 1445 - DNA, 20 bp, Artificial sequence
  Synthetic oligonucleotide
cttgcttgccattatacccc

SEQ ID NO: 1446 - DNA, 20 bp, Artificial sequence
  Synthetic oligonucleotide
tggcactcttgactttgaac

SEQ ID NO: 1447 - DNA, 20 bp, Artificial sequence
  Synthetic oligonucleotide
gcacttcattcatcaggatc

SEQ ID NO: 1448 - DNA, 20 bp, Artificial sequence
  Synthetic oligonucleotide
gctcatgtgcttcttccaac

SEQ ID NO: 1449 - DNA, 20 bp, Artificial sequence
  Synthetic oligonucleotide
gtccacctcatctttttctt

SEQ ID NO: 1450 - DNA, 20 bp, Artificial sequence
  Synthetic oligonucleotide
ccaggcattacaatattgct

SEQ ID NO: 1451 - DNA, 20 bp, Artificial sequence
  Synthetic oligonucleotide
atgccgttcccactctacac

SEQ ID NO: 1452 - DNA, 20 bp, Artificial sequence
  Synthetic oligonucleotide
cccacatttcacccacctcc

SEQ ID NO: 1453 - DNA, 20 bp, Artificial sequence
  Synthetic oligonucleotide
cctcaactcatcctctgtcc

SEQ ID NO: 1454 - DNA, 20 bp, Artificial sequence
  Synthetic oligonucleotide
ataccgtctcttttctggtc

SEQ ID NO: 1455 - DNA, 20 bp, Artificial sequence
  Synthetic oligonucleotide
tccatccccactccatacat

SEQ ID NO: 1456 - DNA, 20 bp, Artificial sequence
  Synthetic oligonucleotide
ttggttgcataccatcttca

SEQ ID NO: 1457 - DNA, 20 bp, Artificial sequence
  Synthetic oligonucleotide
acctctttttcaatgaggtc

SEQ ID NO: 1458 - DNA, 20 bp, Artificial sequence
  Synthetic oligonucleotide
ggtcactcctcatacctgca

SEQ ID NO: 1459 - DNA, 20 bp, Artificial sequence
  Synthetic oligonucleotide
tgtagattcatctttatgtc

SEQ ID NO: 1460 - DNA, 20 bp, Artificial sequence
  Synthetic oligonucleotide
gcctagccacactatataca

SEQ ID NO: 1461 - DNA, 20 bp, Artificial sequence
  Synthetic oligonucleotide
ccaactgttctcatcagtga

SEQ ID NO: 1462 - DNA, 20 bp, Artificial sequence
  Synthetic oligonucleotide
tgctcatttcacatcagaca

SEQ ID NO: 1463 - DNA, 20 bp, Artificial sequence
  Synthetic oligonucleotide
gcaacctgacatactttccc

SEQ ID NO: 1464 - DNA, 20 bp, Artificial sequence
  Synthetic oligonucleotide
gtcctgcttcatacatcctc

SEQ ID NO: 1465 - DNA, 20 bp, Artificial sequence
  Synthetic oligonucleotide
tcggcagtttaaaattctct

SEQ ID NO: 1466 - DNA, 20 bp, Artificial sequence
  Synthetic oligonucleotide
ctggcaagcctttttagtct

SEQ ID NO: 1467 - DNA, 20 bp, Artificial sequence
  Synthetic oligonucleotide
ctgccagtacctccacctgt

SEQ ID NO: 1468 - DNA, 20 bp, Artificial sequence
  Synthetic oligonucleotide
tccactctttcaattctgac

SEQ ID NO: 1469 - DNA, 20 bp, Artificial sequence
  Synthetic oligonucleotide
gccagctcttttctccgttc

SEQ ID NO: 1470 - DNA, 20 bp, Artificial sequence
  Synthetic oligonucleotide
cctggacagctctaatggcc

SEQ ID NO: 1471 - DNA, 20 bp, Artificial sequence
  Synthetic oligonucleotide
gtgccaaccttttcagttca

SEQ ID NO: 1472 - DNA, 20 bp, Artificial sequence
  Synthetic oligonucleotide
gctgccttctctacatacct

SEQ ID NO: 1473 - DNA, 20 bp, Artificial sequence
  Synthetic oligonucleotide
acccatctaactgatcttca

SEQ ID NO: 1474 - DNA, 20 bp, Artificial sequence
  Synthetic oligonucleotide
tgccacctatacaatggagt

SEQ ID NO: 1475 - DNA, 20 bp, Artificial sequence
  Synthetic oligonucleotide
gttaaagaattcttctctca

SEQ ID NO: 1476 - DNA, 20 bp, Artificial sequence
  Synthetic oligonucleotide
cctcttccaacaagcccact

SEQ ID NO: 1477 - DNA, 20 bp, Artificial sequence
  Synthetic oligonucleotide
cgatagtctcctcactgctt

SEQ ID NO: 1478 - DNA, 20 bp, Artificial sequence
  Synthetic oligonucleotide
cctgggtcccaaaaggtccc

SEQ ID NO: 1479 - DNA, 20 bp, Artificial sequence
  Synthetic oligonucleotide
acccattttcctctatccct

SEQ ID NO: 1480 - DNA, 20 bp, Artificial sequence
  Synthetic oligonucleotide
cttcatgtgactctcggtac

SEQ ID NO: 1481 - DNA, 20 bp, Artificial sequence
  Synthetic oligonucleotide
gccaacttctaagctaacaa

SEQ ID NO: 1482 - DNA, 20 bp, Artificial sequence
  Synthetic oligonucleotide
gcttcacattagattctttc

SEQ ID NO: 1483 - DNA, 20 bp, Artificial sequence
  Synthetic oligonucleotide
gagaccaatttatctcaagc

SEQ ID NO: 1484 - DNA, 20 bp, Artificial sequence
  Synthetic oligonucleotide
accatcatctgacctttcca

SEQ ID NO: 1485 - DNA, 20 bp, Artificial sequence
  Synthetic oligonucleotide
aaatgtgatttcactaaccg

SEQ ID NO: 1486 - DNA, 20 bp, Artificial sequence
  Synthetic oligonucleotide
tcatccattccacatggcct

SEQ ID NO: 1487 - DNA, 20 bp, Artificial sequence
  Synthetic oligonucleotide
ggcaatgctttcttttatac

SEQ ID NO: 1488 - DNA, 20 bp, Artificial sequence
  Synthetic oligonucleotide
tgctcatttcatcactaaca

SEQ ID NO: 1489 - DNA, 20 bp, Artificial sequence
  Synthetic oligonucleotide
tcttgaacaactttctgggt

SEQ ID NO: 1490 - DNA, 20 bp, Artificial sequence
  Synthetic oligonucleotide
ttgtcaacccagaacctgta

SEQ ID NO: 1491 - DNA, 20 bp, Artificial sequence
  Synthetic oligonucleotide
tcctactatttttaagccag

SEQ ID NO: 1492 - DNA, 20 bp, Artificial sequence
  Synthetic oligonucleotide
tcttcatgtttttaagagcc

SEQ ID NO: 1493 - DNA, 20 bp, Artificial sequence
  Synthetic oligonucleotide
gcagaaccaacctaagtggc

SEQ ID NO: 1494 - DNA, 20 bp, Artificial sequence
  Synthetic oligonucleotide
acagcattgccataacagct

SEQ ID NO: 1495 - DNA, 20 bp, Artificial sequence
  Synthetic oligonucleotide
tggtactcttctcactgcat

SEQ ID NO: 1496 - DNA, 20 bp, Artificial sequence
  Synthetic oligonucleotide
atgagtaaatcataaaacgg

SEQ ID NO: 1497 - DNA, 20 bp, Artificial sequence
  Synthetic oligonucleotide
cataggctacatccctggcc

SEQ ID NO: 1498 - DNA, 20 bp, Artificial sequence
  Synthetic oligonucleotide
agtcatcttctcatcttaac

SEQ ID NO: 1499 - DNA, 20 bp, Artificial sequence
  Synthetic oligonucleotide
cctccgtcttgatatttgtc

SEQ ID NO: 1500 - DNA, 20 bp, Artificial sequence
  Synthetic oligonucleotide
tcaacatttaatcacccaaa

SEQ ID NO: 1501 - DNA, 20 bp, Artificial sequence
  Synthetic oligonucleotide
tgctgcatagacctagccaa

SEQ ID NO: 1502 - DNA, 20 bp, Artificial sequence
  Synthetic oligonucleotide
gctcagaattcacttgacat

SEQ ID NO: 1503 - DNA, 20 bp, Artificial sequence
  Synthetic oligonucleotide
tctgtcctatctcaagcaac

SEQ ID NO: 1504 - DNA, 20 bp, Artificial sequence
  Synthetic oligonucleotide
ggctctttttactaagccaa

SEQ ID NO: 1505 - DNA, 20 bp, Artificial sequence
  Synthetic oligonucleotide
gttgtttctttacccacatc

SEQ ID NO: 1506 - DNA, 20 bp, Artificial sequence
  Synthetic oligonucleotide
cagttattttttccagacta

SEQ ID NO: 1507 - DNA, 20 bp, Artificial sequence
  Synthetic oligonucleotide
gtgtgcataccttaatctca

SEQ ID NO: 1508 - DNA, 20 bp, Artificial sequence
  Synthetic oligonucleotide
ccaacttattctcaagggaa

SEQ ID NO: 1509 - DNA, 20 bp, Artificial sequence
  Synthetic oligonucleotide
ttcattctatttggtgctct

SEQ ID NO: 1510 - DNA, 20 bp, Artificial sequence
  Synthetic oligonucleotide
tgccagctcttttctccgtt

SEQ ID NO: 1511 - DNA, 20 bp, Artificial sequence
  Synthetic oligonucleotide
tcctcttccaacaagcccac

SEQ ID NO: 1512 - DNA, 20 bp, Artificial sequence
  Synthetic oligonucleotide
ctccactctttcaattctga

SEQ ID NO: 1513 - DNA, 20 bp, Artificial sequence
  Synthetic oligonucleotide
tacctctttttcaatgaggt

SEQ ID NO: 1514 - DNA, 20 bp, Artificial sequence
  Synthetic oligonucleotide
atgtgaacccacttcttgtc

SEQ ID NO: 1515 - DNA, 20 bp, Artificial sequence
  Synthetic oligonucleotide
aggtatgtccttcatgacac

SEQ ID NO: 1516 - DNA, 20 bp, Artificial sequence
  Synthetic oligonucleotide
tggttctcccaatcctgtta

SEQ ID NO: 1517 - DNA, 20 bp, Artificial sequence
  Synthetic oligonucleotide
atctctcaatgaccaggtat

SEQ ID NO: 1518 - DNA, 20 bp, Artificial sequence
  Synthetic oligonucleotide
ccacaacattcattatgttt

SEQ ID NO: 1519 - DNA, 20 bp, Artificial sequence
  Synthetic oligonucleotide
ttgcaggatactacaggcta

SEQ ID NO: 1520 - DNA, 20 bp, Artificial sequence
  Synthetic oligonucleotide
gtcataacatttactcatca

SEQ ID NO: 1521 - DNA, 20 bp, Artificial sequence
  Synthetic oligonucleotide
tcctcaactcatcctctgtc

SEQ ID NO: 1522 - DNA, 20 bp, Artificial sequence
  Synthetic oligonucleotide
gttgctcatttcatcactaa

SEQ ID NO: 1523 - DNA, 20 bp, Artificial sequence
  Synthetic oligonucleotide
gctttagtcatcttctcatc

SEQ ID NO: 1524 - DNA, 20 bp, Artificial sequence
  Synthetic oligonucleotide
cgctatgacaacaccgccca

SEQ ID NO: 1525 - DNA, 20 bp, Artificial sequence
  Synthetic oligonucleotide
gcccacatttcacccacctc

SEQ ID NO: 1526 - DNA, 20 bp, Artificial sequence
  Synthetic oligonucleotide
gcttttccacaccaccctca

SEQ ID NO: 1527 - DNA, 20 bp, Artificial sequence
  Synthetic oligonucleotide
cctgagatttcccttcacta

SEQ ID NO: 1528 - DNA, 20 bp, Artificial sequence
  Synthetic oligonucleotide
gcatgttccttttcatttcc

SEQ ID NO: 1529 - DNA, 20 bp, Artificial sequence
  Synthetic oligonucleotide
gccagaccattttaatacca

SEQ ID NO: 1530 - DNA, 20 bp, Artificial sequence
  Synthetic oligonucleotide
ggttcagaatcacatatcct

SEQ ID NO: 1531 - DNA, 20 bp, Artificial sequence
  Synthetic oligonucleotide
gcgcatttatacaatatact

SEQ ID NO: 1532 - DNA, 20 bp, Artificial sequence
  Synthetic oligonucleotide
gcacactgcgccaacttcta

SEQ ID NO: 1533 - DNA, 20 bp, Artificial sequence
  Synthetic oligonucleotide
gggttatttttccatgtcac

SEQ ID NO: 1534 - DNA, 20 bp, Artificial sequence
  Synthetic oligonucleotide
tctccaacttttccaagtgc

SEQ ID NO: 1535 - DNA, 20 bp, Artificial sequence
  Synthetic oligonucleotide
ctgcagcttcacattagatt

SEQ ID NO: 1536 - DNA, 20 bp, Artificial sequence
  Synthetic oligonucleotide
atccatccccactccataca

SEQ ID NO: 1537 - DNA, 20 bp, Artificial sequence
  Synthetic oligonucleotide
tcccaattccaaatctagct

SEQ ID NO: 1538 - DNA, 20 bp, Artificial sequence
  Synthetic oligonucleotide
tcgaaggataatattcccta

SEQ ID NO: 1539 - DNA, 20 bp, Artificial sequence
  Synthetic oligonucleotide
accaccttttaccaggcatt

SEQ ID NO: 1540 - DNA, 20 bp, Artificial sequence
  Synthetic oligonucleotide
ctacccattttcctctatcc

SEQ ID NO: 1541 - DNA, 20 bp, Artificial sequence
  Synthetic oligonucleotide
gctgcagcacatttgcggat

SEQ ID NO: 1542 - DNA, 20 bp, Artificial sequence
  Synthetic oligonucleotide
tcagccctatgacagagtca

SEQ ID NO: 1543 - DNA, 20 bp, Artificial sequence
  Synthetic oligonucleotide
ttggtactcttctcactgca

SEQ ID NO: 1544 - DNA, 20 bp, Artificial sequence
  Synthetic oligonucleotide
atgcttgattcatttgattc

SEQ ID NO: 1545 - DNA, 20 bp, Artificial sequence
  Synthetic oligonucleotide
gcaacatgcacaatgtagct

SEQ ID NO: 1546 - DNA, 20 bp, Artificial sequence
  Synthetic oligonucleotide
agtccacctcatctttttct

SEQ ID NO: 1547 - DNA, 20 bp, Artificial sequence
  Synthetic oligonucleotide
cctcaccatcatctgacctt

SEQ ID NO: 1548 - DNA, 20 bp, Artificial sequence
  Synthetic oligonucleotide
gtcaacttctcctctgacat

SEQ ID NO: 1549 - DNA, 20 bp, Artificial sequence
  Synthetic oligonucleotide
gagtgccaaccttttcagtt

SEQ ID NO: 1550 - DNA, 20 bp, Artificial sequence
  Synthetic oligonucleotide
gctgactatataaccacata

SEQ ID NO: 1551 - DNA, 20 bp, Artificial sequence
  Synthetic oligonucleotide
gccgtagcaagacttgccca

SEQ ID NO: 1552 - DNA, 20 bp, Artificial sequence
  Synthetic oligonucleotide
tcttgcttgccattataccc

SEQ ID NO: 1553 - DNA, 20 bp, Artificial sequence
  Synthetic oligonucleotide
gctcatcatccattccacat

SEQ ID NO: 1554 - DNA, 20 bp, Artificial sequence
  Synthetic oligonucleotide
ccaatctcttcctcatggct

SEQ ID NO: 1555 - DNA, 20 bp, Artificial sequence
  Synthetic oligonucleotide
gttcttccttaaaacttcga

SEQ ID NO: 1556 - DNA, 20 bp, Artificial sequence
  Synthetic oligonucleotide
acatgccgttcccactctac

SEQ ID NO: 1557 - DNA, 20 bp, Artificial sequence
  Synthetic oligonucleotide
tcatcaactttttagtcctt

SEQ ID NO: 1558 - DNA, 20 bp, Artificial sequence
  Synthetic oligonucleotide
aatgagtaaatcataaaacg

SEQ ID NO: 1559 - DNA, 20 bp, Artificial sequence
  Synthetic oligonucleotide
ggtcctgcttcatacatcct

SEQ ID NO: 1560 - DNA, 20 bp, Artificial sequence
  Synthetic oligonucleotide
caaatgtgatttcactaacc

SEQ ID NO: 1561 - DNA, 20 bp, Artificial sequence
  Synthetic oligonucleotide
tgctgccttctctacatacc

SEQ ID NO: 1562 - DNA, 20 bp, Artificial sequence
  Synthetic oligonucleotide
gctgcagcactctctgcagt

SEQ ID NO: 1563 - DNA, 20 bp, Artificial sequence
  Synthetic oligonucleotide
agcaaatgattatctagtcc

SEQ ID NO: 1564 - DNA, 20 bp, Artificial sequence
  Synthetic oligonucleotide
gcatattcacatcatggttc

SEQ ID NO: 1565 - DNA, 20 bp, Artificial sequence
  Synthetic oligonucleotide
ggcatgttcattctcatccc

SEQ ID NO: 1566 - DNA, 20 bp, Artificial sequence
  Synthetic oligonucleotide
acgagctctttaacggctcc

SEQ ID NO: 1567 - DNA, 20 bp, Artificial sequence
  Synthetic oligonucleotide
tgcctagccacactatatac

SEQ ID NO: 1568 - DNA, 20 bp, Artificial sequence
  Synthetic oligonucleotide
gcatttcatcacaatttgtt

SEQ ID NO: 1569 - DNA, 20 bp, Artificial sequence
  Synthetic oligonucleotide
cgtggccatctccaacaggc

SEQ ID NO: 1570 - DNA, 20 bp, Artificial sequence
  Synthetic oligonucleotide
agctcctttaccctgacact

SEQ ID NO: 1571 - DNA, 20 bp, Artificial sequence
  Synthetic oligonucleotide
attctcttgaacaactttct

SEQ ID NO: 1572 - DNA, 20 bp, Artificial sequence
  Synthetic oligonucleotide
tgcacttcattcatcaggat

SEQ ID NO: 1573 - DNA, 20 bp, Artificial sequence
  Synthetic oligonucleotide
gtccacccatctaactgatc

SEQ ID NO: 1574 - DNA, 20 bp, Artificial sequence
  Synthetic oligonucleotide
gctgactcaccattgaccca

SEQ ID NO: 1575 - DNA, 20 bp, Artificial sequence
  Synthetic oligonucleotide
gctacagatgttcttagcca

SEQ ID NO: 1576 - DNA, 20 bp, Artificial sequence
  Synthetic oligonucleotide
tggatctttaatctccagcc

SEQ ID NO: 1577 - DNA, 20 bp, Artificial sequence
  Synthetic oligonucleotide
tgtcaacactaacccaactt

SEQ ID NO: 1578 - DNA, 20 bp, Artificial sequence
  Synthetic oligonucleotide
atctgcatctctgcaggccc

SEQ ID NO: 1579 - DNA, 20 bp, Artificial sequence
  Synthetic oligonucleotide
ataatgagtaaatcataaaa

SEQ ID NO: 1580 - DNA, 20 bp, Artificial sequence
  Synthetic oligonucleotide
tcccatacatgattttaggt

SEQ ID NO: 1581 - DNA, 20 bp, Artificial sequence
  Synthetic oligonucleotide
gttggttctcccaatcctgt

SEQ ID NO: 1582 - DNA, 20 bp, Artificial sequence
  Synthetic oligonucleotide
tcaaattgtacacaccaggc

SEQ ID NO: 1583 - DNA, 20 bp, Artificial sequence
  Synthetic oligonucleotide
ttgctgcatagacctagcca

SEQ ID NO: 1584 - DNA, 20 bp, Artificial sequence
  Synthetic oligonucleotide
tgtcataacatttactcatc

SEQ ID NO: 1585 - DNA, 20 bp, Artificial sequence
  Synthetic oligonucleotide
ttctgtcattacacatcctc

SEQ ID NO: 1586 - DNA, 20 bp, Artificial sequence
  Synthetic oligonucleotide
tcgctatgacaacaccgccc

SEQ ID NO: 1587 - DNA, 20 bp, Artificial sequence
  Synthetic oligonucleotide
attcattctatttggtgctc

SEQ ID NO: 1588 - DNA, 20 bp, Artificial sequence
  Synthetic oligonucleotide
atgctgcagcactctctgca

SEQ ID NO: 1589 - DNA, 20 bp, Artificial sequence
  Synthetic oligonucleotide
ggcccacatttcacccacct

SEQ ID NO: 1590 - DNA, 20 bp, Artificial sequence
  Synthetic oligonucleotide
cccggtcttcaacactcctt

SEQ ID NO: 1591 - DNA, 20 bp, Artificial sequence
  Synthetic oligonucleotide
atggttatcaaacacatgcc

SEQ ID NO: 1592 - DNA, 20 bp, Artificial sequence
  Synthetic oligonucleotide
tggctctttttactaagcca

SEQ ID NO: 1593 - DNA, 20 bp, Artificial sequence
  Synthetic oligonucleotide
tgctcatcatccattccaca

SEQ ID NO: 1594 - DNA, 20 bp, Artificial sequence
  Synthetic oligonucleotide
tggtcctgcttcatacatcc

SEQ ID NO: 1595 - DNA, 20 bp, Artificial sequence
  Synthetic oligonucleotide
cgcaaatgtgatttcactaa

SEQ ID NO: 1596 - DNA, 20 bp, Artificial sequence
  Synthetic oligonucleotide
tcagagatctcctccgtctt

SEQ ID NO: 1597 - DNA, 20 bp, Artificial sequence
  Synthetic oligonucleotide
catacccaattacatccagt

SEQ ID NO: 1598 - DNA, 20 bp, Artificial sequence
  Synthetic oligonucleotide
tgtcaacttctcctctgaca

SEQ ID NO: 1599 - DNA, 20 bp, Artificial sequence
  Synthetic oligonucleotide
gcttaattatatatcttcac

SEQ ID NO: 1600 - DNA, 20 bp, Artificial sequence
  Synthetic oligonucleotide
atgccagctcttttctccgt

SEQ ID NO: 1601 - DNA, 20 bp, Artificial sequence
  Synthetic oligonucleotide
ccattcctcatttaacctcg

SEQ ID NO: 1602 - DNA, 20 bp, Artificial sequence
  Synthetic oligonucleotide
tgcaactaatttttgcaatc

SEQ ID NO: 1603 - DNA, 20 bp, Artificial sequence
  Synthetic oligonucleotide
ggtccatctctccccttcct

SEQ ID NO: 1604 - DNA, 20 bp, Artificial sequence
  Synthetic oligonucleotide
ccagctctctcttcctgtaa

SEQ ID NO: 1605 - DNA, 20 bp, Artificial sequence
  Synthetic oligonucleotide
tagggtctaatttcaggtcc

SEQ ID NO: 1606 - DNA, 20 bp, Artificial sequence
  Synthetic oligonucleotide
acgattgttttccaagggcc

SEQ ID NO: 1607 - DNA, 20 bp, Artificial sequence
  Synthetic oligonucleotide
ccctacttttctttcttgga

SEQ ID NO: 1608 - DNA, 20 bp, Artificial sequence
  Synthetic oligonucleotide
cctgctatttattcaggaac

SEQ ID NO: 1609 - DNA, 20 bp, Artificial sequence
  Synthetic oligonucleotide
tctctcctgcgaccagcctc

SEQ ID NO: 1610 - DNA, 20 bp, Artificial sequence
  Synthetic oligonucleotide
ctttatcactttactatgca

SEQ ID NO: 1611 - DNA, 20 bp, Artificial sequence
  Synthetic oligonucleotide
ttatttctttcactcaggcc

SEQ ID NO: 1612 - DNA, 20 bp, Artificial sequence
  Synthetic oligonucleotide
tgcgcatttatacaatatac

SEQ ID NO: 1613 - DNA, 20 bp, Artificial sequence
  Synthetic oligonucleotide
ggtcatcaactttttagtcc

SEQ ID NO: 1614 - DNA, 20 bp, Artificial sequence
  Synthetic oligonucleotide
gttggtactcttctcactgc

SEQ ID NO: 1615 - DNA, 20 bp, Artificial sequence
  Synthetic oligonucleotide
gcttattttcaccaagcctc

SEQ ID NO: 1616 - DNA, 20 bp, Artificial sequence
  Synthetic oligonucleotide
ctctacttattcttgtccac

SEQ ID NO: 1617 - DNA, 20 bp, Artificial sequence
  Synthetic oligonucleotide
gcagcatttcatcacaattt

SEQ ID NO: 1618 - DNA, 20 bp, Artificial sequence
  Synthetic oligonucleotide
caccaccttttaccaggcat

SEQ ID NO: 1619 - DNA, 20 bp, Artificial sequence
  Synthetic oligonucleotide
ggtcattcttctattttgcc

SEQ ID NO: 1620 - DNA, 20 bp, Artificial sequence
  Synthetic oligonucleotide
gccctggtctaaactctcct

SEQ ID NO: 1621 - DNA, 20 bp, Artificial sequence
  Synthetic oligonucleotide
ccacgagctctttaacggct

SEQ ID NO: 1622 - DNA, 20 bp, Artificial sequence
  Synthetic oligonucleotide
ttgctatctctcaatgacca

SEQ ID NO: 1623 - DNA, 20 bp, Artificial sequence
  Synthetic oligonucleotide
gagctcctttaccctgacac

SEQ ID NO: 1624 - DNA, 20 bp, Artificial sequence
  Synthetic oligonucleotide
gctcacggagaatcttagct

SEQ ID NO: 1625 - DNA, 20 bp, Artificial sequence
  Synthetic oligonucleotide
gctcagaattacacactaat

SEQ ID NO: 1626 - DNA, 20 bp, Artificial sequence
  Synthetic oligonucleotide
cctggttcatagaatgagct

SEQ ID NO: 1627 - DNA, 20 bp, Artificial sequence
  Synthetic oligonucleotide
gcatctccttccactgtgtc

SEQ ID NO: 1628 - DNA, 20 bp, Artificial sequence
  Synthetic oligonucleotide
gtctcctcaactcatcctct

SEQ ID NO: 1629 - DNA, 20 bp, Artificial sequence
  Synthetic oligonucleotide
gcaacaggccactaacatgc

SEQ ID NO: 1630 - DNA, 20 bp, Artificial sequence
  Synthetic oligonucleotide
acagatgtcttatcatggtc

SEQ ID NO: 1631 - DNA, 20 bp, Artificial sequence
  Synthetic oligonucleotide
ctagctttagtcatcttctc

SEQ ID NO: 1632 - DNA, 20 bp, Artificial sequence
  Synthetic oligonucleotide
tggcaggcatattcacatca

SEQ ID NO: 1633 - DNA, 20 bp, Artificial sequence
  Synthetic oligonucleotide
gcatttgtttcctcaggctc

SEQ ID NO: 1634 - DNA, 20 bp, Artificial sequence
  Synthetic oligonucleotide
gtgtccctacaatatgaccc

SEQ ID NO: 1635 - DNA, 20 bp, Artificial sequence
  Synthetic oligonucleotide
gcaaagctcctaacacgcca

SEQ ID NO: 1636 - DNA, 20 bp, Artificial sequence
  Synthetic oligonucleotide
gccacagtatcacatgacca

SEQ ID NO: 1637 - DNA, 20 bp, Artificial sequence
  Synthetic oligonucleotide
gcatacttacaattatgtct

SEQ ID NO: 1638 - DNA, 20 bp, Artificial sequence
  Synthetic oligonucleotide
tacctctttttcatacctct

SEQ ID NO: 1639 - DNA, 20 bp, Artificial sequence
  Synthetic oligonucleotide
ctgcacttcattcatcagga

SEQ ID NO: 1640 - DNA, 20 bp, Artificial sequence
  Synthetic oligonucleotide
gtaggtacacaactgtactc

SEQ ID NO: 1641 - DNA, 20 bp, Artificial sequence
  Synthetic oligonucleotide
gcctcctccactctttcaat

SEQ ID NO: 1642 - DNA, 20 bp, Artificial sequence
  Synthetic oligonucleotide
gcagttgctcatttcatcac

SEQ ID NO: 1643 - DNA, 20 bp, Artificial sequence
  Synthetic oligonucleotide
gggacattctctctcggtgc

SEQ ID NO: 1644 - DNA, 20 bp, Artificial sequence
  Synthetic oligonucleotide
gcatttcccatccatcccca

SEQ ID NO: 1645 - DNA, 20 bp, Artificial sequence
  Synthetic oligonucleotide
ccttagtccacctcatcttt

SEQ ID NO: 1646 - DNA, 20 bp, Artificial sequence
  Synthetic oligonucleotide
tttgcaggatactacaggct

SEQ ID NO: 1647 - DNA, 20 bp, Artificial sequence
  Synthetic oligonucleotide
gcatgatattcctcaccatc

SEQ ID NO: 1648 - DNA, 20 bp, Artificial sequence
  Synthetic oligonucleotide
agctcagaattcacttgaca

SEQ ID NO: 1649 - DNA, 20 bp, Artificial sequence
  Synthetic oligonucleotide
agggttatttttccatgtca

SEQ ID NO: 1650 - DNA, 20 bp, Artificial sequence
  Synthetic oligonucleotide
tctctctcccaccacttgtt

SEQ ID NO: 1651 - DNA, 20 bp, Artificial sequence
  Synthetic oligonucleotide
gccaacttattctcaaggga

SEQ ID NO: 1652 - DNA, 20 bp, Artificial sequence
  Synthetic oligonucleotide
gctgcagcttcacattagat

SEQ ID NO: 1653 - DNA, 20 bp, Artificial sequence
  Synthetic oligonucleotide
caggctcagaattacacact

SEQ ID NO: 1654 - DNA, 20 bp, Artificial sequence
  Synthetic oligonucleotide
ggcatttcccatccatcccc

SEQ ID NO: 1655 - DNA, 20 bp, Artificial sequence
  Synthetic oligonucleotide
ccaggtctttgataatgaac

SEQ ID NO: 1656 - DNA, 20 bp, Artificial sequence
  Synthetic oligonucleotide
cttctgtcattacacatcct

SEQ ID NO: 1657 - DNA, 20 bp, Artificial sequence
  Synthetic oligonucleotide
gtccatcattaataagacct

SEQ ID NO: 1658 - DNA, 20 bp, Artificial sequence
  Synthetic oligonucleotide
gcacacgctcaccagtgtct

SEQ ID NO: 1659 - DNA, 20 bp, Artificial sequence
  Synthetic oligonucleotide
ccggtacatacccaattaca

SEQ ID NO: 1660 - DNA, 20 bp, Artificial sequence
  Synthetic oligonucleotide
gtggcaggcatattcacatc

SEQ ID NO: 1661 - DNA, 20 bp, Artificial sequence
  Synthetic oligonucleotide
agcacttttcaacaaggcct

SEQ ID NO: 1662 - DNA, 20 bp, Artificial sequence
  Synthetic oligonucleotide
gctggtacctctttggcgac

SEQ ID NO: 1663 - DNA, 20 bp, Artificial sequence
  Synthetic oligonucleotide
cagcatgtcaacactaaccc

SEQ ID NO: 1664 - DNA, 20 bp, Artificial sequence
  Synthetic oligonucleotide
ctgcagtatctcatctttgc

SEQ ID NO: 1665 - DNA, 20 bp, Artificial sequence
  Synthetic oligonucleotide
agagctcctttaccctgaca

SEQ ID NO: 1666 - DNA, 20 bp, Artificial sequence
  Synthetic oligonucleotide
tttcttcgatattattgtct

SEQ ID NO: 1667 - DNA, 20 bp, Artificial sequence
  Synthetic oligonucleotide
gccattcctcatttaacctc

SEQ ID NO: 1668 - DNA, 20 bp, Artificial sequence
  Synthetic oligonucleotide
ggaggcccacatttcaccca

SEQ ID NO: 1669 - DNA, 20 bp, Artificial sequence
  Synthetic oligonucleotide
cagcaaagctcctaacacgc

SEQ ID NO: 1670 - DNA, 20 bp, Artificial sequence
  Synthetic oligonucleotide
ctacttgtcatattagggtc

SEQ ID NO: 1671 - DNA, 20 bp, Artificial sequence
  Synthetic oligonucleotide
cctgatccatgcacttggta

SEQ ID NO: 1672 - DNA, 20 bp, Artificial sequence
  Synthetic oligonucleotide
cgatactatttctatcacat

SEQ ID NO: 1673 - DNA, 20 bp, Artificial sequence
  Synthetic oligonucleotide
cctcagttatcacctgggtt

SEQ ID NO: 1674 - DNA, 20 bp, Artificial sequence
  Synthetic oligonucleotide
tgtctgctccgccccaccag

SEQ ID NO: 1675 - DNA, 20 bp, Artificial sequence
  Synthetic oligonucleotide
tcaacactaacttctctctc

SEQ ID NO: 1676 - DNA, 20 bp, Artificial sequence
  Synthetic oligonucleotide
cttgtgttacagcacagctg

SEQ ID NO: 1677 - DNA, 20 bp, Artificial sequence
  Synthetic oligonucleotide
gtcctttatccactaactct

SEQ ID NO: 1678 - DNA, 20 bp, Artificial sequence
  Synthetic oligonucleotide
tccagctctctcttcctgta

SEQ ID NO: 1679 - DNA, 20 bp, Artificial sequence
  Synthetic oligonucleotide
ttcagagatctcctccgtct

SEQ ID NO: 1680 - DNA, 20 bp, Artificial sequence
  Synthetic oligonucleotide
gcattactacttcaagctaa

SEQ ID NO: 1681 - DNA, 20 bp, Artificial sequence
  Synthetic oligonucleotide
cagtgtatttaccttagtcc

SEQ ID NO: 1682 - DNA, 20 bp, Artificial sequence
  Synthetic oligonucleotide
tcccacttcccattctggac

SEQ ID NO: 1683 - DNA, 20 bp, Artificial sequence
  Synthetic oligonucleotide
atgcaagctcagaattcact

SEQ ID NO: 1684 - DNA, 20 bp, Artificial sequence
  Synthetic oligonucleotide
gtgtcataacatttactcat

SEQ ID NO: 1685 - DNA, 20 bp, Artificial sequence
  Synthetic oligonucleotide
tctggctcactgattttgct

SEQ ID NO: 1686 - DNA, 20 bp, Artificial sequence
  Synthetic oligonucleotide
ctgaaatattccctgggcat

SEQ ID NO: 1687 - DNA, 20 bp, Artificial sequence
  Synthetic oligonucleotide
tactacttacacatttggaa

SEQ ID NO: 1688 - DNA, 20 bp, Artificial sequence
  Synthetic oligonucleotide
cattcattctatttggtgct

SEQ ID NO: 1689 - DNA, 20 bp, Artificial sequence
  Synthetic oligonucleotide
cgttgcaactaatttttgca

SEQ ID NO: 1690 - DNA, 20 bp, Artificial sequence
  Synthetic oligonucleotide
gggtcattcttctattttgc

SEQ ID NO: 1691 - DNA, 20 bp, Artificial sequence
  Synthetic oligonucleotide
tggaggcctctctcctgcga

SEQ ID NO: 1692 - DNA, 20 bp, Artificial sequence
  Synthetic oligonucleotide
ctctttatcactttactatg

SEQ ID NO: 1693 - DNA, 20 bp, Artificial sequence
  Synthetic oligonucleotide
ctggcatctccttccactgt

SEQ ID NO: 1694 - DNA, 20 bp, Artificial sequence
  Synthetic oligonucleotide
cccttccatccactacagct

SEQ ID NO: 1695 - DNA, 20 bp, Artificial sequence
  Synthetic oligonucleotide
cccaattccaattcctctac

SEQ ID NO: 1696 - DNA, 20 bp, Artificial sequence
  Synthetic oligonucleotide
tggtcatcaactttttagtc

SEQ ID NO: 1697 - DNA, 20 bp, Artificial sequence
  Synthetic oligonucleotide
tgccacagtatcacatgacc

SEQ ID NO: 1698 - DNA, 20 bp, Artificial sequence
  Synthetic oligonucleotide
tggacagcatgatattcctc

SEQ ID NO: 1699 - DNA, 20 bp, Artificial sequence
  Synthetic oligonucleotide
catgcattcctgccctggtc

SEQ ID NO: 1700 - DNA, 20 bp, Artificial sequence
  Synthetic oligonucleotide
gacaggtccatctctcccct

SEQ ID NO: 1701 - DNA, 20 bp, Artificial sequence
  Synthetic oligonucleotide
acgaccttacactaggttct

SEQ ID NO: 1702 - DNA, 20 bp, Artificial sequence
  Synthetic oligonucleotide
agtttcttacttcctgtctc

SEQ ID NO: 1703 - DNA, 20 bp, Artificial sequence
  Synthetic oligonucleotide
tttgctacttgataatccta

SEQ ID NO: 1704 - DNA, 20 bp, Artificial sequence
  Synthetic oligonucleotide
gcattagtctaccacctaca

SEQ ID NO: 1705 - DNA, 20 bp, Artificial sequence
  Synthetic oligonucleotide
tgtctgcattttccaggcac

SEQ ID NO: 1706 - DNA, 20 bp, Artificial sequence
  Synthetic oligonucleotide
cccaacctattaccctacaa

SEQ ID NO: 1707 - DNA, 20 bp, Artificial sequence
  Synthetic oligonucleotide
ccatttcatattcatactaa

SEQ ID NO: 1708 - DNA, 20 bp, Artificial sequence
  Synthetic oligonucleotide
gcaccaccttttaccaggca

SEQ ID NO: 1709 - DNA, 20 bp, Artificial sequence
  Synthetic oligonucleotide
gtgctcatcatccattccac

SEQ ID NO: 1710 - DNA, 20 bp, Artificial sequence
  Synthetic oligonucleotide
actgtcgctatgacaacacc

SEQ ID NO: 1711 - DNA, 20 bp, Artificial sequence
  Synthetic oligonucleotide
tcctgctgctaaaagccttc

SEQ ID NO: 1712 - DNA, 20 bp, Artificial sequence
  Synthetic oligonucleotide
aatgtctttttctctgcaac

SEQ ID NO: 1713 - DNA, 20 bp, Artificial sequence
  Synthetic oligonucleotide
tgcttaattatatatcttca

SEQ ID NO: 1714 - DNA, 20 bp, Artificial sequence
  Synthetic oligonucleotide
ttggctctttttactaagcc

SEQ ID NO: 1715 - DNA, 20 bp, Artificial sequence
  Synthetic oligonucleotide
tcattcaaattgtacacacc

SEQ ID NO: 1716 - DNA, 20 bp, Artificial sequence
  Synthetic oligonucleotide
gtggtcctgcttcatacatc

SEQ ID NO: 1717 - DNA, 20 bp, Artificial sequence
  Synthetic oligonucleotide
gcctcattctataacagcta

SEQ ID NO: 1718 - DNA, 20 bp, Artificial sequence
  Synthetic oligonucleotide
tgcttattttcaccaagcct

SEQ ID NO: 1719 - DNA, 20 bp, Artificial sequence
  Synthetic oligonucleotide
gtggtctatttcaacattgc

SEQ ID NO: 1720 - DNA, 20 bp, Artificial sequence
  Synthetic oligonucleotide
gtgcttccctagctttagtc

SEQ ID NO: 1721 - DNA, 20 bp, Artificial sequence
  Synthetic oligonucleotide
agtctcctcaactcatcctc

SEQ ID NO: 1722 - DNA, 20 bp, Artificial sequence
  Synthetic oligonucleotide
ctcataatatcctcatctgt

SEQ ID NO: 1723 - DNA, 20 bp, Artificial sequence
  Synthetic oligonucleotide
tagcactgcaaaacccttca

SEQ ID NO: 1724 - DNA, 20 bp, Artificial sequence
  Synthetic oligonucleotide
tgaggcttatactctctact

SEQ ID NO: 1725 - DNA, 20 bp, Artificial sequence
  Synthetic oligonucleotide
tgtcactcaaatgccagctc

SEQ ID NO: 1726 - DNA, 20 bp, Artificial sequence
  Synthetic oligonucleotide
gtcaacagcctcctccactc

SEQ ID NO: 1727 - DNA, 20 bp, Artificial sequence
  Synthetic oligonucleotide
gcacaaacattttatatctt

SEQ ID NO: 1728 - DNA, 20 bp, Artificial sequence
  Synthetic oligonucleotide
agcatttcctacctcctcct

SEQ ID NO: 1729 - DNA, 20 bp, Artificial sequence
  Synthetic oligonucleotide
cctcttgatttcctttatct

SEQ ID NO: 1730 - DNA, 20 bp, Artificial sequence
  Synthetic oligonucleotide
gcaacactcactcacccatt

SEQ ID NO: 1731 - DNA, 20 bp, Artificial sequence
  Synthetic oligonucleotide
gtgcttattttcaccaagcc

SEQ ID NO: 1732 - DNA, 20 bp, Artificial sequence
  Synthetic oligonucleotide
tctctttatcactttactat

SEQ ID NO: 1733 - DNA, 20 bp, Artificial sequence
  Synthetic oligonucleotide
tggcaaactctcttaggttc

SEQ ID NO: 1734 - DNA, 20 bp, Artificial sequence
  Synthetic oligonucleotide
cacgaccttacactaggttc

SEQ ID NO: 1735 - DNA, 20 bp, Artificial sequence
  Synthetic oligonucleotide
cagtctcctcaactcatcct

SEQ ID NO: 1736 - DNA, 20 bp, Artificial sequence
  Synthetic oligonucleotide
ccaatgtctttttctctgca

SEQ ID NO: 1737 - DNA, 20 bp, Artificial sequence
  Synthetic oligonucleotide
acttcatttatgctatgcct

SEQ ID NO: 1738 - DNA, 20 bp, Artificial sequence
  Synthetic oligonucleotide
gttggctctttttactaagc

SEQ ID NO: 1739 - DNA, 20 bp, Artificial sequence
  Synthetic oligonucleotide
tgctgagaccacatctgttt

SEQ ID NO: 1740 - DNA, 20 bp, Artificial sequence
  Synthetic oligonucleotide
tgcattcattctatttggtg

SEQ ID NO: 1741 - DNA, 20 bp, Artificial sequence
  Synthetic oligonucleotide
atctcttattctcataagta

SEQ ID NO: 1742 - DNA, 20 bp, Artificial sequence
  Synthetic oligonucleotide
aggttctaccatcccagcta

SEQ ID NO: 1743 - DNA, 20 bp, Artificial sequence
  Synthetic oligonucleotide
cttggatgtttctaccataa

SEQ ID NO: 1744 - DNA, 20 bp, Artificial sequence
  Synthetic oligonucleotide
tccctccatttctttccggt

SEQ ID NO: 1745 - DNA, 20 bp, Artificial sequence
  Synthetic oligonucleotide
gcatattcatacttggacta

SEQ ID NO: 1746 - DNA, 20 bp, Artificial sequence
  Synthetic oligonucleotide
agccattcctcatttaacct

SEQ ID NO: 1747 - DNA, 20 bp, Artificial sequence
  Synthetic oligonucleotide
gcccactatcaactctgtaa

SEQ ID NO: 1748 - DNA, 20 bp, Artificial sequence
  Synthetic oligonucleotide
actgcatctttctaaagggt

SEQ ID NO: 1749 - DNA, 20 bp, Artificial sequence
  Synthetic oligonucleotide
tgtgatcacaatcaacacta

SEQ ID NO: 1750 - DNA, 20 bp, Artificial sequence
  Synthetic oligonucleotide
ctctcataatatcctcatct

SEQ ID NO: 1751 - DNA, 20 bp, Artificial sequence
  Synthetic oligonucleotide
acaccatattacttatgcac

SEQ ID NO: 1752 - DNA, 20 bp, Artificial sequence
  Synthetic oligonucleotide
gaaggccctcaacctgcaca

SEQ ID NO: 1753 - DNA, 20 bp, Artificial sequence
  Synthetic oligonucleotide
cggcatttcccatccatccc

SEQ ID NO: 1754 - DNA, 20 bp, Artificial sequence
  Synthetic oligonucleotide
tacttgtgttacagcacagc

SEQ ID NO: 1755 - DNA, 20 bp, Artificial sequence
  Synthetic oligonucleotide
gcagtctttttctcactttt

SEQ ID NO: 1756 - DNA, 20 bp, Artificial sequence
  Synthetic oligonucleotide
tcccaacctattaccctaca

SEQ ID NO: 1757 - DNA, 20 bp, Artificial sequence
  Synthetic oligonucleotide
agtgtcataacatttactca

SEQ ID NO: 1758 - DNA, 20 bp, Artificial sequence
  Synthetic oligonucleotide
tgctcagccccatccctagc

SEQ ID NO: 1759 - DNA, 20 bp, Artificial sequence
  Synthetic oligonucleotide
ttcttcagcatcaccaaggt

SEQ ID NO: 1760 - DNA, 20 bp, Artificial sequence
  Synthetic oligonucleotide
ccttttctaatccataccca

SEQ ID NO: 1761 - DNA, 20 bp, Artificial sequence
  Synthetic oligonucleotide
ctgcttaatacatcctgttc

SEQ ID NO: 1762 - DNA, 20 bp, Artificial sequence
  Synthetic oligonucleotide
tggcattactacttcaagct

SEQ ID NO: 1763 - DNA, 20 bp, Artificial sequence
  Synthetic oligonucleotide
cctggtttcatatatggttt

SEQ ID NO: 1764 - DNA, 20 bp, Artificial sequence
  Synthetic oligonucleotide
cttcagagatctcctccgtc

SEQ ID NO: 1765 - DNA, 20 bp, Artificial sequence
  Synthetic oligonucleotide
gtggcattagtctaccacct

SEQ ID NO: 1766 - DNA, 20 bp, Artificial sequence
  Synthetic oligonucleotide
ccatagttcctctcccttcc

SEQ ID NO: 1767 - DNA, 20 bp, Artificial sequence
  Synthetic oligonucleotide
tccatttcatattcatacta

SEQ ID NO: 1768 - DNA, 20 bp, Artificial sequence
  Synthetic oligonucleotide
ccatcaatactgtatctttc

SEQ ID NO: 1769 - DNA, 20 bp, Artificial sequence
  Synthetic oligonucleotide
ggtcattactacttacacat

SEQ ID NO: 1770 - DNA, 20 bp, Artificial sequence
  Synthetic oligonucleotide
gctacagttcaacttgtcca

SEQ ID NO: 1771 - DNA, 20 bp, Artificial sequence
  Synthetic oligonucleotide
gcgatactatttctatcaca

SEQ ID NO: 1772 - DNA, 20 bp, Artificial sequence
  Synthetic oligonucleotide
gtcaagagctcctttaccct

SEQ ID NO: 1773 - DNA, 20 bp, Artificial sequence
  Synthetic oligonucleotide
aagcacttttcaacaaggcc

SEQ ID NO: 1774 - DNA, 20 bp, Artificial sequence
  Synthetic oligonucleotide
gcagtgtatttaccttagtc

SEQ ID NO: 1775 - DNA, 20 bp, Artificial sequence
  Synthetic oligonucleotide
ggcttctgtcattacacatc

SEQ ID NO: 1776 - DNA, 20 bp, Artificial sequence
  Synthetic oligonucleotide
ccatgactttttcaaatcaa

SEQ ID NO: 1777 - DNA, 20 bp, Artificial sequence
  Synthetic oligonucleotide
gtgactccagctctctcttc

SEQ ID NO: 1778 - DNA, 20 bp, Artificial sequence
  Synthetic oligonucleotide
tgcctcattctataacagct

SEQ ID NO: 1779 - DNA, 20 bp, Artificial sequence
  Synthetic oligonucleotide
gctgccctattcttgggcat

SEQ ID NO: 1780 - DNA, 20 bp, Artificial sequence
  Synthetic oligonucleotide
ggtcaacagcctcctccact

SEQ ID NO: 1781 - DNA, 20 bp, Artificial sequence
  Synthetic oligonucleotide
gctgaggcttatactctcta

SEQ ID NO: 1782 - DNA, 20 bp, Artificial sequence
  Synthetic oligonucleotide
cgagcaaattcctcatgtcc

SEQ ID NO: 1783 - DNA, 20 bp, Artificial sequence
  Synthetic oligonucleotide
ttgtctgcattttccaggca

SEQ ID NO: 1784 - DNA, 20 bp, Artificial sequence
  Synthetic oligonucleotide
tgtgtctgctccgccccacc

SEQ ID NO: 1785 - DNA, 20 bp, Artificial sequence
  Synthetic oligonucleotide
cctccatattatcaaactcc

SEQ ID NO: 1786 - DNA, 20 bp, Artificial sequence
  Synthetic oligonucleotide
cagtttcttacttcctgtct

SEQ ID NO: 1787 - DNA, 20 bp, Artificial sequence
  Synthetic oligonucleotide
agcctgcttttctctttcac

SEQ ID NO: 1788 - DNA, 20 bp, Artificial sequence
  Synthetic oligonucleotide
tctcattagcatataagacc

SEQ ID NO: 1789 - DNA, 20 bp, Artificial sequence
  Synthetic oligonucleotide
caggacagttttccaggtct

SEQ ID NO: 1790 - DNA, 20 bp, Artificial sequence
  Synthetic oligonucleotide
tcctcttttatcactacaac

SEQ ID NO: 1791 - DNA, 20 bp, Artificial sequence
  Synthetic oligonucleotide
tgcccatgcattcctgccct

SEQ ID NO: 1792 - DNA, 20 bp, Artificial sequence
  Synthetic oligonucleotide
tccctcctgatccatgcact

SEQ ID NO: 1793 - DNA, 20 bp, Artificial sequence
  Synthetic oligonucleotide
gcagatcatatactatacac

SEQ ID NO: 1794 - DNA, 20 bp, Artificial sequence
  Synthetic oligonucleotide
ggcaccaccttttaccaggc

SEQ ID NO: 1795 - DNA, 20 bp, Artificial sequence
  Synthetic oligonucleotide
acctcttgatttcctttatc

SEQ ID NO: 1796 - DNA, 20 bp, Artificial sequence
  Synthetic oligonucleotide
aggaaatcttcactttgcaa

SEQ ID NO: 1797 - DNA, 20 bp, Artificial sequence
  Synthetic oligonucleotide
catcatggttcatactcctt

SEQ ID NO: 1798 - DNA, 20 bp, Artificial sequence
  Synthetic oligonucleotide
tcccaattccaattcctcta

SEQ ID NO: 1799 - DNA, 20 bp, Artificial sequence
  Synthetic oligonucleotide
tcaacagcatgtcaacacta

SEQ ID NO: 1800 - DNA, 20 bp, Artificial sequence
  Synthetic oligonucleotide
tgacaggtccatctctcccc

SEQ ID NO: 1801 - DNA, 20 bp, Artificial sequence
  Synthetic oligonucleotide
cctccagatcttaagcagct

SEQ ID NO: 1802 - DNA, 20 bp, Artificial sequence
  Synthetic oligonucleotide
gcagcacctatattccttaa

SEQ ID NO: 1803 - DNA, 20 bp, Artificial sequence
  Synthetic oligonucleotide
gctggtgcacaatccagacc

SEQ ID NO: 1804 - DNA, 20 bp, Artificial sequence
  Synthetic oligonucleotide
ttgcaccatcaccacctact

SEQ ID NO: 1805 - DNA, 20 bp, Artificial sequence
  Synthetic oligonucleotide
gtgtgctcatcatccattcc

SEQ ID NO: 1806 - DNA, 20 bp, Artificial sequence
  Synthetic oligonucleotide
ccaaatttcaccatgtggca

SEQ ID NO: 1807 - DNA, 20 bp, Artificial sequence
  Synthetic oligonucleotide
acagtattcaaatacatcct

SEQ ID NO: 1808 - DNA, 20 bp, Artificial sequence
  Synthetic oligonucleotide
aagctctcctcacactgtaa

SEQ ID NO: 1809 - DNA, 20 bp, Artificial sequence
  Synthetic oligonucleotide
gtcagtctcctcaactcatc

SEQ ID NO: 1810 - DNA, 20 bp, Artificial sequence
  Synthetic oligonucleotide
tcccatagttcctctccctt

SEQ ID NO: 1811 - DNA, 20 bp, Artificial sequence
  Synthetic oligonucleotide
gctgatttcaccctaagccc

SEQ ID NO: 1812 - DNA, 20 bp, Artificial sequence
  Synthetic oligonucleotide
ctacttgtgttacagcacag

SEQ ID NO: 1813 - DNA, 20 bp, Artificial sequence
  Synthetic oligonucleotide
gcagaactccttcccaaaga

SEQ ID NO: 1814 - DNA, 20 bp, Artificial sequence
  Synthetic oligonucleotide
tggaaggccctcaacctgca

SEQ ID NO: 1815 - DNA, 20 bp, Artificial sequence
  Synthetic oligonucleotide
agtcaagagctcctttaccc

SEQ ID NO: 1816 - DNA, 20 bp, Artificial sequence
  Synthetic oligonucleotide
atgacaggtccatctctccc

SEQ ID NO: 1817 - DNA, 20 bp, Artificial sequence
  Synthetic oligonucleotide
atgcccatgcattcctgccc

SEQ ID NO: 1818 - DNA, 20 bp, Artificial sequence
  Synthetic oligonucleotide
ctgtgtctgctccgccccac

SEQ ID NO: 1819 - DNA, 20 bp, Artificial sequence
  Synthetic oligonucleotide
gaggcattttttctttttgc

SEQ ID NO: 1820 - DNA, 20 bp, Artificial sequence
  Synthetic oligonucleotide
ttgcattcattctatttggt

SEQ ID NO: 1821 - DNA, 20 bp, Artificial sequence
  Synthetic oligonucleotide
tcatcatttcacatcatggt

SEQ ID NO: 1822 - DNA, 20 bp, Artificial sequence
  Synthetic oligonucleotide
gcctactgatgaatacactt

SEQ ID NO: 1823 - DNA, 20 bp, Artificial sequence
  Synthetic oligonucleotide
gctccctcctgatccatgca

SEQ ID NO: 1824 - DNA, 20 bp, Artificial sequence
  Synthetic oligonucleotide
ccatctgaatttgacctcca

SEQ ID NO: 1825 - DNA, 20 bp, Artificial sequence
  Synthetic oligonucleotide
cgggaactctattttctgtt

SEQ ID NO: 1826 - DNA, 20 bp, Artificial sequence
  Synthetic oligonucleotide
tctgtattatactctgggct

SEQ ID NO: 1827 - DNA, 20 bp, Artificial sequence
  Synthetic oligonucleotide
tggcagatcatatactatac

SEQ ID NO: 1828 - DNA, 20 bp, Artificial sequence
  Synthetic oligonucleotide
gcatccatcaatactgtatc

SEQ ID NO: 1829 - DNA, 20 bp, Artificial sequence
  Synthetic oligonucleotide
atgcatcaattcctttgggt

SEQ ID NO: 1830 - DNA, 20 bp, Artificial sequence
  Synthetic oligonucleotide
gtgcaccaacaataaatcaa

SEQ ID NO: 1831 - DNA, 20 bp, Artificial sequence
  Synthetic oligonucleotide
ctgcatttgaaccacccgct

SEQ ID NO: 1832 - DNA, 20 bp, Artificial sequence
  Synthetic oligonucleotide
tgctgaggcttatactctct

SEQ ID NO: 1833 - DNA, 20 bp, Artificial sequence
  Synthetic oligonucleotide
agtcaagtttacctacctcc

SEQ ID NO: 1834 - DNA, 20 bp, Artificial sequence
  Synthetic oligonucleotide
cagcaacactcactcaccca

SEQ ID NO: 1835 - DNA, 20 bp, Artificial sequence
  Synthetic oligonucleotide
ggtcacttcaaattctactc

SEQ ID NO: 1836 - DNA, 20 bp, Artificial sequence
  Synthetic oligonucleotide
tcagtttcttacttcctgtc

SEQ ID NO: 1837 - DNA, 20 bp, Artificial sequence
  Synthetic oligonucleotide
gatgcagaactatttagggc

SEQ ID NO: 1838 - DNA, 20 bp, Artificial sequence
  Synthetic oligonucleotide
gctgcagcactcatgagtca

SEQ ID NO: 1839 - DNA, 20 bp, Artificial sequence
  Synthetic oligonucleotide
acccacacatgaaagtacca

SEQ ID NO: 1840 - DNA, 20 bp, Artificial sequence
  Synthetic oligonucleotide
gttgtctgcattttccaggc

SEQ ID NO: 1841 - DNA, 20 bp, Artificial sequence
  Synthetic oligonucleotide
ccacgaccttacactaggtt

SEQ ID NO: 1842 - DNA, 20 bp, Artificial sequence
  Synthetic oligonucleotide
cagccattcctcatttaacc

SEQ ID NO: 1843 - DNA, 20 bp, Artificial sequence
  Synthetic oligonucleotide
ctgattataatactttgtcc

SEQ ID NO: 1844 - DNA, 20 bp, Artificial sequence
  Synthetic oligonucleotide
acggcatttcccatccatcc

SEQ ID NO: 1845 - DNA, 20 bp, Artificial sequence
  Synthetic oligonucleotide
gttcattgcaccatcaccac

SEQ ID NO: 1846 - DNA, 20 bp, Artificial sequence
  Synthetic oligonucleotide
atcttcttttaccacatcaa

SEQ ID NO: 1847 - DNA, 20 bp, Artificial sequence
  Synthetic oligonucleotide
tggccatacgcacccacaca

SEQ ID NO: 1848 - DNA, 20 bp, Artificial sequence
  Synthetic oligonucleotide
gtctctttatcactttacta

SEQ ID NO: 1849 - DNA, 20 bp, Artificial sequence
  Synthetic oligonucleotide
tatttcctttcaaagtgtca

SEQ ID NO: 1850 - DNA, 20 bp, Artificial sequence
  Synthetic oligonucleotide
tcgcactgagatcctaccaa

SEQ ID NO: 1851 - DNA, 20 bp, Artificial sequence
  Synthetic oligonucleotide
agacatcttctcatttgggt

SEQ ID NO: 1852 - DNA, 20 bp, Artificial sequence
  Synthetic oligonucleotide
gcaccttcaaatgtctgaca

SEQ ID NO: 1853 - DNA, 20 bp, Artificial sequence
  Synthetic oligonucleotide
gtgcacgcagattttctcct

SEQ ID NO: 1854 - DNA, 20 bp, Artificial sequence
  Synthetic oligonucleotide
tgtttatcacaaatatggct

SEQ ID NO: 1855 - DNA, 20 bp, Artificial sequence
  Synthetic oligonucleotide
agacatatcatccatgccta

SEQ ID NO: 1856 - DNA, 20 bp, Artificial sequence
  Synthetic oligonucleotide
cctgtgcttattttcaccaa

SEQ ID NO: 1857 - DNA, 20 bp, Artificial sequence
  Synthetic oligonucleotide
gctgtcaacaatcatttgca

SEQ ID NO: 1858 - DNA, 20 bp, Artificial sequence
  Synthetic oligonucleotide
ccatgcccatttgatttata

SEQ ID NO: 1859 - DNA, 20 bp, Artificial sequence
  Synthetic oligonucleotide
acttcagagatctcctccgt

SEQ ID NO: 1860 - DNA, 20 bp, Artificial sequence
  Synthetic oligonucleotide
ttgcatattcatacttggac

SEQ ID NO: 1861 - DNA, 20 bp, Artificial sequence
  Synthetic oligonucleotide
ttggcattactacttcaagc

SEQ ID NO: 1862 - DNA, 20 bp, Artificial sequence
  Synthetic oligonucleotide
ccagcctacaagccttttct

SEQ ID NO: 1863 - DNA, 20 bp, Artificial sequence
  Synthetic oligonucleotide
ctctgcttaatacatcctgt

SEQ ID NO: 1864 - DNA, 20 bp, Artificial sequence
  Synthetic oligonucleotide
ccactttcatcactttacta

SEQ ID NO: 1865 - DNA, 20 bp, Artificial sequence
  Synthetic oligonucleotide
agatctttattcattcactt

SEQ ID NO: 1866 - DNA, 20 bp, Artificial sequence
  Synthetic oligonucleotide
actcatatatttgttggctc

SEQ ID NO: 1867 - DNA, 20 bp, Artificial sequence
  Synthetic oligonucleotide
acagaatcccttcaccccat

SEQ ID NO: 1868 - DNA, 20 bp, Artificial sequence
  Synthetic oligonucleotide
gcactccatttcatattcat

SEQ ID NO: 1869 - DNA, 20 bp, Artificial sequence
  Synthetic oligonucleotide
atcctcttttatcactacaa

SEQ ID NO: 1870 - DNA, 20 bp, Artificial sequence
  Synthetic oligonucleotide
atgacttttctttatgcaac

SEQ ID NO: 1871 - DNA, 20 bp, Artificial sequence
  Synthetic oligonucleotide
atgcaagtctgaaccatcta

SEQ ID NO: 1872 - DNA, 20 bp, Artificial sequence
  Synthetic oligonucleotide
atccaaccctccaggaacct

SEQ ID NO: 1873 - DNA, 20 bp, Artificial sequence
  Synthetic oligonucleotide
tgtgtgtgctcatcatccat

SEQ ID NO: 1874 - DNA, 20 bp, Artificial sequence
  Synthetic oligonucleotide
gccaacaattaagaaacacc

SEQ ID NO: 1875 - DNA, 20 bp, Artificial sequence
  Synthetic oligonucleotide
tgctctcataatatcctcat

SEQ ID NO: 1876 - DNA, 20 bp, Artificial sequence
  Synthetic oligonucleotide
aaagcacttttcaacaaggc

SEQ ID NO: 1877 - DNA, 20 bp, Artificial sequence
  Synthetic oligonucleotide
tccaatgtctttttctctgc

SEQ ID NO: 1878 - DNA, 20 bp, Artificial sequence
  Synthetic oligonucleotide
cagagcttccatcctcggga

SEQ ID NO: 1879 - DNA, 20 bp, Artificial sequence
  Synthetic oligonucleotide
tcccatccccttcaggccca

SEQ ID NO: 1880 - DNA, 20 bp, Artificial sequence
  Synthetic oligonucleotide
caggttctaccatcccagct

SEQ ID NO: 1881 - DNA, 20 bp, Artificial sequence
  Synthetic oligonucleotide
gtgctgccctattcttgggc

SEQ ID NO: 1882 - DNA, 20 bp, Artificial sequence
  Synthetic oligonucleotide
gcagaataccaagttagtac

SEQ ID NO: 1883 - DNA, 20 bp, Artificial sequence
  Synthetic oligonucleotide
gctgtgctttaccaagtgcc

SEQ ID NO: 1884 - DNA, 20 bp, Artificial sequence
  Synthetic oligonucleotide
gttccatcactctagctgga

SEQ ID NO: 1885 - DNA, 20 bp, Artificial sequence
  Synthetic oligonucleotide
ggactccacgaccttacact

SEQ ID NO: 1886 - DNA, 20 bp, Artificial sequence
  Synthetic oligonucleotide
agggctttgctcaaatggac

SEQ ID NO: 1887 - DNA, 20 bp, Artificial sequence
  Synthetic oligonucleotide
gcgatcctcaactctacttc

SEQ ID NO: 1888 - DNA, 20 bp, Artificial sequence
  Synthetic oligonucleotide
ctctgtattatactctgggc

SEQ ID NO: 1889 - DNA, 20 bp, Artificial sequence
  Synthetic oligonucleotide
tagccagtacttctcccgca

SEQ ID NO: 1890 - DNA, 20 bp, Artificial sequence
  Synthetic oligonucleotide
gttcaggttctaccatccca

SEQ ID NO: 1891 - DNA, 20 bp, Artificial sequence
  Synthetic oligonucleotide
tcactcatatatttgttggc

SEQ ID NO: 1892 - DNA, 20 bp, Artificial sequence
  Synthetic oligonucleotide
gcaggcttacttagaggtct

SEQ ID NO: 1893 - DNA, 20 bp, Artificial sequence
  Synthetic oligonucleotide
tgttcattgcaccatcacca

SEQ ID NO: 1894 - DNA, 20 bp, Artificial sequence
  Synthetic oligonucleotide
cttctggttttttattggct

SEQ ID NO: 1895 - DNA, 20 bp, Artificial sequence
  Synthetic oligonucleotide
gacggcatttcccatccatc

SEQ ID NO: 1896 - DNA, 20 bp, Artificial sequence
  Synthetic oligonucleotide
ctctcatagtcttaattccc

SEQ ID NO: 1897 - DNA, 20 bp, Artificial sequence
  Synthetic oligonucleotide
gctgaactctttgacttatt

SEQ ID NO: 1898 - DNA, 20 bp, Artificial sequence
  Synthetic oligonucleotide
gcactccctcacctcgccct

SEQ ID NO: 1899 - DNA, 20 bp, Artificial sequence
  Synthetic oligonucleotide
ccacggctacagatcacacc

SEQ ID NO: 1900 - DNA, 20 bp, Artificial sequence
  Synthetic oligonucleotide
atgccactacatgcagggtc

SEQ ID NO: 1901 - DNA, 20 bp, Artificial sequence
  Synthetic oligonucleotide
attgcctcatacttgttggt

SEQ ID NO: 1902 - DNA, 20 bp, Artificial sequence
  Synthetic oligonucleotide
ccccactttcatcactttac

SEQ ID NO: 1903 - DNA, 20 bp, Artificial sequence
  Synthetic oligonucleotide
atgcatccatcaatactgta

SEQ ID NO: 1904 - DNA, 20 bp, Artificial sequence
  Synthetic oligonucleotide
atgctctcataatatcctca

SEQ ID NO: 1905 - DNA, 20 bp, Artificial sequence
  Synthetic oligonucleotide
catcactgtctatatctcta

SEQ ID NO: 1906 - DNA, 20 bp, Artificial sequence
  Synthetic oligonucleotide
attgcattcattctatttgg

SEQ ID NO: 1907 - DNA, 20 bp, Artificial sequence
  Synthetic oligonucleotide
gttcaccttttaatctacaa

SEQ ID NO: 1908 - DNA, 20 bp, Artificial sequence
  Synthetic oligonucleotide
tagggctccctcctgatcca

SEQ ID NO: 1909 - DNA, 20 bp, Artificial sequence
  Synthetic oligonucleotide
gctgttttaaaaccatgctt

SEQ ID NO: 1910 - DNA, 20 bp, Artificial sequence
  Synthetic oligonucleotide
gcttaccttctagttcagct

SEQ ID NO: 1911 - DNA, 20 bp, Artificial sequence
  Synthetic oligonucleotide
ccatatgtgacactccagca

SEQ ID NO: 1912 - DNA, 20 bp, Artificial sequence
  Synthetic oligonucleotide
gtacatgtttacatacccat

SEQ ID NO: 1913 - DNA, 20 bp, Artificial sequence
  Synthetic oligonucleotide
gcaggtgattcctaagattc

SEQ ID NO: 1914 - DNA, 20 bp, Artificial sequence
  Synthetic oligonucleotide
atctttggtaaccatgccca

SEQ ID NO: 1915 - DNA, 20 bp, Artificial sequence
  Synthetic oligonucleotide
gcagcaacactcactcaccc

SEQ ID NO: 1916 - DNA, 20 bp, Artificial sequence
  Synthetic oligonucleotide
gctggctccaatcattgtca

SEQ ID NO: 1917 - DNA, 20 bp, Artificial sequence
  Synthetic oligonucleotide
tctgtgtctgctccgcccca

SEQ ID NO: 1918 - DNA, 20 bp, Artificial sequence
  Synthetic oligonucleotide
gtaagctctcctcacactgt

SEQ ID NO: 1919 - DNA, 20 bp, Artificial sequence
  Synthetic oligonucleotide
gatcatgtgacactcgcact

SEQ ID NO: 1920 - DNA, 20 bp, Artificial sequence
  Synthetic oligonucleotide
ctgtagctttgacactagca

SEQ ID NO: 1921 - DNA, 20 bp, Artificial sequence
  Synthetic oligonucleotide
tctacttgtgttacagcaca

SEQ ID NO: 1922 - DNA, 20 bp, Artificial sequence
  Synthetic oligonucleotide
actggctgtcaacaatcatt

SEQ ID NO: 1923 - DNA, 20 bp, Artificial sequence
  Synthetic oligonucleotide
gcacagaatcccttcacccc

SEQ ID NO: 1924 - DNA, 20 bp, Artificial sequence
  Synthetic oligonucleotide
gtctacatctatctgggctt

SEQ ID NO: 1925 - DNA, 20 bp, Artificial sequence
  Synthetic oligonucleotide
tttcctgacatccaaccctc

SEQ ID NO: 1926 - DNA, 20 bp, Artificial sequence
  Synthetic oligonucleotide
tggttttaattctctcatca

SEQ ID NO: 1927 - DNA, 20 bp, Artificial sequence
  Synthetic oligonucleotide
tatatatttcaggcattttc

SEQ ID NO: 1928 - DNA, 20 bp, Artificial sequence
  Synthetic oligonucleotide
ctttctatttactcacagcc

SEQ ID NO: 1929 - DNA, 20 bp, Artificial sequence
  Synthetic oligonucleotide
gccactgattataatacttt

SEQ ID NO: 1930 - DNA, 20 bp, Artificial sequence
  Synthetic oligonucleotide
gcagcatcctcctcccctct

SEQ ID NO: 1931 - DNA, 20 bp, Artificial sequence
  Synthetic oligonucleotide
gactctctcactcccacata

SEQ ID NO: 1932 - DNA, 20 bp, Artificial sequence
  Synthetic oligonucleotide
acagaatttatgcccatgca

SEQ ID NO: 1933 - DNA, 20 bp, Artificial sequence
  Synthetic oligonucleotide
cacccatgctattagagctc

SEQ ID NO: 1934 - DNA, 20 bp, Artificial sequence
  Synthetic oligonucleotide
tgaatctagttcaactggcc

SEQ ID NO: 1935 - DNA, 20 bp, Artificial sequence
  Synthetic oligonucleotide
gtggaaggccctcaacctgc

SEQ ID NO: 1936 - DNA, 20 bp, Artificial sequence
  Synthetic oligonucleotide
tccttcccatagttcctctc

SEQ ID NO: 1937 - DNA, 20 bp, Artificial sequence
  Synthetic oligonucleotide
atgctacgcttacaatagca

SEQ ID NO: 1938 - DNA, 20 bp, Artificial sequence
  Synthetic oligonucleotide
cagacatatcatccatgcct

SEQ ID NO: 1939 - DNA, 20 bp, Artificial sequence
  Synthetic oligonucleotide
aaggtcttagaaatctctct

SEQ ID NO: 1940 - DNA, 20 bp, Artificial sequence
  Synthetic oligonucleotide
ccatcctcatcgccatcttt

SEQ ID NO: 1941 - DNA, 20 bp, Artificial sequence
  Synthetic oligonucleotide
tgccactaaatttaattcca

SEQ ID NO: 1942 - DNA, 20 bp, Artificial sequence
  Synthetic oligonucleotide
gtacggccaatctccagtca

SEQ ID NO: 1943 - DNA, 20 bp, Artificial sequence
  Synthetic oligonucleotide
cctttctatttttagcagat

SEQ ID NO: 1944 - DNA, 20 bp, Artificial sequence
  Synthetic oligonucleotide
gcttggcagcattcctcccc

SEQ ID NO: 1945 - DNA, 20 bp, Artificial sequence
  Synthetic oligonucleotide
gcacttctcactgatagttt

SEQ ID NO: 1946 - DNA, 20 bp, Artificial sequence
  Synthetic oligonucleotide
acctcaatttcctcactgcc

SEQ ID NO: 1947 - DNA, 20 bp, Artificial sequence
  Synthetic oligonucleotide
tccctcttactctcggaggc

SEQ ID NO: 1948 - DNA, 20 bp, Artificial sequence
  Synthetic oligonucleotide
tcatcctcttttatcactac

SEQ ID NO: 1949 - DNA, 20 bp, Artificial sequence
  Synthetic oligonucleotide
cccatggcttttttcctata

SEQ ID NO: 1950 - DNA, 20 bp, Artificial sequence
  Synthetic oligonucleotide
ttcacttcagagatctcctc

SEQ ID NO: 1951 - DNA, 20 bp, Artificial sequence
  Synthetic oligonucleotide
gctaaggttttccaaaccta

SEQ ID NO: 1952 - DNA, 20 bp, Artificial sequence
  Synthetic oligonucleotide
atggttttattcttacagca

SEQ ID NO: 1953 - DNA, 20 bp, Artificial sequence
  Synthetic oligonucleotide
gctgctggctcactgcagaa

SEQ ID NO: 1954 - DNA, 20 bp, Artificial sequence
  Synthetic oligonucleotide
cctcactgtatctactgtaa

SEQ ID NO: 1955 - DNA, 20 bp, Artificial sequence
  Synthetic oligonucleotide
ctgcatcaaatcctttcaga

SEQ ID NO: 1956 - DNA, 20 bp, Artificial sequence
  Synthetic oligonucleotide
atgcactgatttccctcatt

SEQ ID NO: 1957 - DNA, 20 bp, Artificial sequence
  Synthetic oligonucleotide
ccttatttacaacctgccta

SEQ ID NO: 1958 - DNA, 20 bp, Artificial sequence
  Synthetic oligonucleotide
ctgcctttctgataaagcta

SEQ ID NO: 1959 - DNA, 20 bp, Artificial sequence
  Synthetic oligonucleotide
atctacttgtgttacagcac

SEQ ID NO: 1960 - DNA, 20 bp, Artificial sequence
  Synthetic oligonucleotide
gtctgtgtctgctccgcccc

SEQ ID NO: 1961 - DNA, 20 bp, Artificial sequence
  Synthetic oligonucleotide
tgttcaggttctaccatccc

SEQ ID NO: 1962 - DNA, 20 bp, Artificial sequence
  Synthetic oligonucleotide
tccccagctttgacttctcc

SEQ ID NO: 1963 - DNA, 20 bp, Artificial sequence
  Synthetic oligonucleotide
attttctatgcatccatcaa

SEQ ID NO: 1964 - DNA, 20 bp, Artificial sequence
  Synthetic oligonucleotide
actcagtcagtcactcatat

SEQ ID NO: 1965 - DNA, 20 bp, Artificial sequence
  Synthetic oligonucleotide
actaaaccttacattctgga

SEQ ID NO: 1966 - DNA, 20 bp, Artificial sequence
  Synthetic oligonucleotide
ctgttgtgttactttagcca

SEQ ID NO: 1967 - DNA, 20 bp, Artificial sequence
  Synthetic oligonucleotide
ctgcaatcacactccatcaa

SEQ ID NO: 1968 - DNA, 20 bp, Artificial sequence
  Synthetic oligonucleotide
gagctgaaatcccatcccct

SEQ ID NO: 1969 - DNA, 20 bp, Artificial sequence
  Synthetic oligonucleotide
gctcaattaaactgatagcc

SEQ ID NO: 1970 - DNA, 20 bp, Artificial sequence
  Synthetic oligonucleotide
atccatcttcacttcagaga

SEQ ID NO: 1971 - DNA, 20 bp, Artificial sequence
  Synthetic oligonucleotide
ctgtaagctctcctcacact

SEQ ID NO: 1972 - DNA, 20 bp, Artificial sequence
  Synthetic oligonucleotide
gccacggctacagatcacac

SEQ ID NO: 1973 - DNA, 20 bp, Artificial sequence
  Synthetic oligonucleotide
gtcatcctcttttatcacta

SEQ ID NO: 1974 - DNA, 20 bp, Artificial sequence
  Synthetic oligonucleotide
acacactgtttcaagcattt

SEQ ID NO: 1975 - DNA, 20 bp, Artificial sequence
  Synthetic oligonucleotide
tttgttccatcactctagct

SEQ ID NO: 1976 - DNA, 20 bp, Artificial sequence
  Synthetic oligonucleotide
cagaagttccctcttactct

SEQ ID NO: 1977 - DNA, 20 bp, Artificial sequence
  Synthetic oligonucleotide
cttgcttaccttctagttca

SEQ ID NO: 1978 - DNA, 20 bp, Artificial sequence
  Synthetic oligonucleotide
tggtacttttctatcggttc

SEQ ID NO: 1979 - DNA, 20 bp, Artificial sequence
  Synthetic oligonucleotide
tgcgatcctcaactctactt

SEQ ID NO: 1980 - DNA, 20 bp, Artificial sequence
  Synthetic oligonucleotide
ccattgacctatctatgcat

SEQ ID NO: 1981 - DNA, 20 bp, Artificial sequence
  Synthetic oligonucleotide
tggactccacgaccttacac

SEQ ID NO: 1982 - DNA, 20 bp, Artificial sequence
  Synthetic oligonucleotide
tctatatatttcaggcattt

SEQ ID NO: 1983 - DNA, 20 bp, Artificial sequence
  Synthetic oligonucleotide
gccctttccttcatgatgtc

SEQ ID NO: 1984 - DNA, 20 bp, Artificial sequence
  Synthetic oligonucleotide
cactcgatctttctaggctc

SEQ ID NO: 1985 - DNA, 20 bp, Artificial sequence
  Synthetic oligonucleotide
gcaacttcctacttctattt

SEQ ID NO: 1986 - DNA, 20 bp, Artificial sequence
  Synthetic oligonucleotide
tccatcctcatcgccatctt

SEQ ID NO: 1987 - DNA, 20 bp, Artificial sequence
  Synthetic oligonucleotide
catgcactgatttccctcat

SEQ ID NO: 1988 - DNA, 20 bp, Artificial sequence
  Synthetic oligonucleotide
ctgcatgtcttctacaaaca

SEQ ID NO: 1989 - DNA, 20 bp, Artificial sequence
  Synthetic oligonucleotide
gcatgatgcactccctcacc

SEQ ID NO: 1990 - DNA, 20 bp, Artificial sequence
  Synthetic oligonucleotide
cctttctatttactcacagc

SEQ ID NO: 1991 - DNA, 20 bp, Artificial sequence
  Synthetic oligonucleotide
gctcttgctataatagttca

SEQ ID NO: 1992 - DNA, 20 bp, Artificial sequence
  Synthetic oligonucleotide
cccatttctttttcagatca

SEQ ID NO: 1993 - DNA, 20 bp, Artificial sequence
  Synthetic oligonucleotide
ctccctgtattaatctgatc

SEQ ID NO: 1994 - DNA, 20 bp, Artificial sequence
  Synthetic oligonucleotide
gcacacacacaataagcctt

SEQ ID NO: 1995 - DNA, 20 bp, Artificial sequence
  Synthetic oligonucleotide
ggtctaactcaaatagtgct

SEQ ID NO: 1996 - DNA, 20 bp, Artificial sequence
  Synthetic oligonucleotide
agccactgattataatactt

SEQ ID NO: 1997 - DNA, 20 bp, Artificial sequence
  Synthetic oligonucleotide
tccttatcatgacaaggcat

SEQ ID NO: 1998 - DNA, 20 bp, Artificial sequence
  Synthetic oligonucleotide
tctacatactctaccaggtt

SEQ ID NO: 1999 - DNA, 20 bp, Artificial sequence
  Synthetic oligonucleotide
tcagacatatcatccatgcc

SEQ ID NO: 2000 - DNA, 20 bp, Artificial sequence
  Synthetic oligonucleotide
ggcagcaacactcactcacc

SEQ ID NO: 2001 - DNA, 20 bp, Artificial sequence
  Synthetic oligonucleotide
gcagaggttaaccaagtgct

SEQ ID NO: 2002 - DNA, 20 bp, Artificial sequence
  Synthetic oligonucleotide
atggcttacaaaattcctct

SEQ ID NO: 2003 - DNA, 20 bp, Artificial sequence
  Synthetic oligonucleotide
ctgccttgtttacctcacct

SEQ ID NO: 2004 - DNA, 20 bp, Artificial sequence
  Synthetic oligonucleotide
gcttgcttacttaggaggct

SEQ ID NO: 2005 - DNA, 20 bp, Artificial sequence
  Synthetic oligonucleotide
gttcttgtctctcatatgta

SEQ ID NO: 2006 - DNA, 20 bp, Artificial sequence
  Synthetic oligonucleotide
agattacacatcccacaggc

SEQ ID NO: 2007 - DNA, 20 bp, Artificial sequence
  Synthetic oligonucleotide
gctactcttcatcattcact

SEQ ID NO: 2008 - DNA, 20 bp, Artificial sequence
  Synthetic oligonucleotide
gcaaaccacttctgtagctt

SEQ ID NO: 2009 - DNA, 20 bp, Artificial sequence
  Synthetic oligonucleotide
agttgatacaaataatgctc

SEQ ID NO: 2010 - DNA, 20 bp, Artificial sequence
  Synthetic oligonucleotide
tcccctgccaccttctgtct

SEQ ID NO: 2011 - DNA, 20 bp, Artificial sequence
  Synthetic oligonucleotide
tgtcacactaaacactagct

SEQ ID NO: 2012 - DNA, 20 bp, Artificial sequence
  Synthetic oligonucleotide
tgactctctcactcccacat

SEQ ID NO: 2013 - DNA, 20 bp, Artificial sequence
  Synthetic oligonucleotide
gcccaacatctcaagctgtc

SEQ ID NO: 2014 - DNA, 20 bp, Artificial sequence
  Synthetic oligonucleotide
ggtcctattatacctctact

SEQ ID NO: 2015 - DNA, 20 bp, Artificial sequence
  Synthetic oligonucleotide
ctccatgtacttcctctaac

SEQ ID NO: 2016 - DNA, 20 bp, Artificial sequence
  Synthetic oligonucleotide
tgccactgacatcataaaac

SEQ ID NO: 2017 - DNA, 20 bp, Artificial sequence
  Synthetic oligonucleotide
tccttatttacaacctgcct

SEQ ID NO: 2018 - DNA, 20 bp, Artificial sequence
  Synthetic oligonucleotide
tgggatctaagacccttaca

SEQ ID NO: 2019 - DNA, 20 bp, Artificial sequence
  Synthetic oligonucleotide
ggacttttttcttcttgcta

SEQ ID NO: 2020 - DNA, 20 bp, Artificial sequence
  Synthetic oligonucleotide
aggagccatctccctgccat

SEQ ID NO: 2021 - DNA, 20 bp, Artificial sequence
  Synthetic oligonucleotide
gaagtacttaatcaagggct

SEQ ID NO: 2022 - DNA, 20 bp, Artificial sequence
  Synthetic oligonucleotide
gtctaatccatcactgtcta

SEQ ID NO: 2023 - DNA, 20 bp, Artificial sequence
  Synthetic oligonucleotide
gtattgcattcattctattt

SEQ ID NO: 2024 - DNA, 20 bp, Artificial sequence
  Synthetic oligonucleotide
tgtacggccaatctccagtc

SEQ ID NO: 2025 - DNA, 20 bp, Artificial sequence
  Synthetic oligonucleotide
actcatccttcccatagttc

SEQ ID NO: 2026 - DNA, 20 bp, Artificial sequence
  Synthetic oligonucleotide
tcactcctcactgtatctac

SEQ ID NO: 2027 - DNA, 20 bp, Artificial sequence
  Synthetic oligonucleotide
tttctctctgtatactggtt

SEQ ID NO: 2028 - DNA, 20 bp, Artificial sequence
  Synthetic oligonucleotide
catctaccatcacactggct

SEQ ID NO: 2029 - DNA, 20 bp, Artificial sequence
  Synthetic oligonucleotide
gcccactcataagccataac

SEQ ID NO: 2030 - DNA, 20 bp, Artificial sequence
  Synthetic oligonucleotide
ccaccccactttcatcactt

SEQ ID NO: 2031 - DNA, 20 bp, Artificial sequence
  Synthetic oligonucleotide
acacctctagaattcatctt

SEQ ID NO: 2032 - DNA, 20 bp, Artificial sequence
  Synthetic oligonucleotide
gctgtaatgcaccatactca

SEQ ID NO: 2033 - DNA, 20 bp, Artificial sequence
  Synthetic oligonucleotide
cttcacagtactcacttaca

SEQ ID NO: 2034 - DNA, 20 bp, Artificial sequence
  Synthetic oligonucleotide
ggcacagaatcccttcaccc

SEQ ID NO: 2035 - DNA, 20 bp, Artificial sequence
  Synthetic oligonucleotide
gcacattatattccagagcc

SEQ ID NO: 2036 - DNA, 20 bp, Artificial sequence
  Synthetic oligonucleotide
catctacttgtgttacagca

SEQ ID NO: 2037 - DNA, 20 bp, Artificial sequence
  Synthetic oligonucleotide
tctcacaacactttgggtct

SEQ ID NO: 2038 - DNA, 20 bp, Artificial sequence
  Synthetic oligonucleotide
agtcatcctcttttatcact

SEQ ID NO: 2039 - DNA, 20 bp, Artificial sequence
  Synthetic oligonucleotide
gctcattccttcccctgcca

SEQ ID NO: 2040 - DNA, 20 bp, Artificial sequence
  Synthetic oligonucleotide
cccagagcttaccttcagtt

SEQ ID NO: 2041 - DNA, 20 bp, Artificial sequence
  Synthetic oligonucleotide
tcagcataatattctactgt

SEQ ID NO: 2042 - DNA, 20 bp, Artificial sequence
  Synthetic oligonucleotide
gcctgactctctcactccca

SEQ ID NO: 2043 - DNA, 20 bp, Artificial sequence
  Synthetic oligonucleotide
caccactccctcaagctgta

SEQ ID NO: 2044 - DNA, 20 bp, Artificial sequence
  Synthetic oligonucleotide
agcaaaccacttctgtagct

SEQ ID NO: 2045 - DNA, 20 bp, Artificial sequence
  Synthetic oligonucleotide
gtaacatatttactcagtat

SEQ ID NO: 2046 - DNA, 20 bp, Artificial sequence
  Synthetic oligonucleotide
ctgtaagtgcaatactgccc

SEQ ID NO: 2047 - DNA, 20 bp, Artificial sequence
  Synthetic oligonucleotide
gttccttttcacctatcctt

SEQ ID NO: 2048 - DNA, 20 bp, Artificial sequence
  Synthetic oligonucleotide
gtttttccatcctcatcgcc

SEQ ID NO: 2049 - DNA, 20 bp, Artificial sequence
  Synthetic oligonucleotide
gtctatatatttcaggcatt

SEQ ID NO: 2050 - DNA, 20 bp, Artificial sequence
  Synthetic oligonucleotide
tccccagtatctatctcatc

SEQ ID NO: 2051 - DNA, 20 bp, Artificial sequence
  Synthetic oligonucleotide
gcaaccattttattgttcac

SEQ ID NO: 2052 - DNA, 20 bp, Artificial sequence
  Synthetic oligonucleotide
gctactgcaatcacactcca

SEQ ID NO: 2053 - DNA, 20 bp, Artificial sequence
  Synthetic oligonucleotide
cgggtctgtatcattcagga

SEQ ID NO: 2054 - DNA, 20 bp, Artificial sequence
  Synthetic oligonucleotide
tcggatatttgacatttact

SEQ ID NO: 2055 - DNA, 20 bp, Artificial sequence
  Synthetic oligonucleotide
cccattgacctatctatgca

SEQ ID NO: 2056 - DNA, 20 bp, Artificial sequence
  Synthetic oligonucleotide
cagaaactatgattctcttc

SEQ ID NO: 2057 - DNA, 20 bp, Artificial sequence
  Synthetic oligonucleotide
ggttacatatatattaactc

SEQ ID NO: 2058 - DNA, 20 bp, Artificial sequence
  Synthetic oligonucleotide
atggactccacgaccttaca

SEQ ID NO: 2059 - DNA, 20 bp, Artificial sequence
  Synthetic oligonucleotide
tcaaggtttctatccagctt

SEQ ID NO: 2060 - DNA, 20 bp, Artificial sequence
  Synthetic oligonucleotide
tgttgaacatttattgctct

SEQ ID NO: 2061 - DNA, 20 bp, Artificial sequence
  Synthetic oligonucleotide
gctttctcactcagacatat

SEQ ID NO: 2062 - DNA, 20 bp, Artificial sequence
  Synthetic oligonucleotide
ccattggtatttcaagctac

SEQ ID NO: 2063 - DNA, 20 bp, Artificial sequence
  Synthetic oligonucleotide
gcttctgactttactgctgt

SEQ ID NO: 2064 - DNA, 20 bp, Artificial sequence
  Synthetic oligonucleotide
caccaatcccacttctccaa

SEQ ID NO: 2065 - DNA, 20 bp, Artificial sequence
  Synthetic oligonucleotide
cctctcccacttgccagatc

SEQ ID NO: 2066 - DNA, 20 bp, Artificial sequence
  Synthetic oligonucleotide
actgccttgtttacctcacc

SEQ ID NO: 2067 - DNA, 20 bp, Artificial sequence
  Synthetic oligonucleotide
tcccatttctttttcagatc

SEQ ID NO: 2068 - DNA, 20 bp, Artificial sequence
  Synthetic oligonucleotide
actggagttttacacctcta

SEQ ID NO: 2069 - DNA, 20 bp, Artificial sequence
  Synthetic oligonucleotide
ccatctttattctatgagcc

SEQ ID NO: 2070 - DNA, 20 bp, Artificial sequence
  Synthetic oligonucleotide
tcaacctcacccctattgtt

SEQ ID NO: 2071 - DNA, 20 bp, Artificial sequence
  Synthetic oligonucleotide
tcactttcttacatgcggtt

SEQ ID NO: 2072 - DNA, 20 bp, Artificial sequence
  Synthetic oligonucleotide
ttgctgtgttcccaaagtac

SEQ ID NO: 2073 - DNA, 20 bp, Artificial sequence
  Synthetic oligonucleotide
actcatcttctactgcagta

SEQ ID NO: 2074 - DNA, 20 bp, Artificial sequence
  Synthetic oligonucleotide
acattctcttcttcctagtt

SEQ ID NO: 2075 - DNA, 20 bp, Artificial sequence
  Synthetic oligonucleotide
ctgcatccatcttcacttca

SEQ ID NO: 2076 - DNA, 20 bp, Artificial sequence
  Synthetic oligonucleotide
acaggcttgcttaccttcta

SEQ ID NO: 2077 - DNA, 20 bp, Artificial sequence
  Synthetic oligonucleotide
gtgctctctcacctgggaac

SEQ ID NO: 2078 - DNA, 20 bp, Artificial sequence
  Synthetic oligonucleotide
ctcactcgatctttctaggc

SEQ ID NO: 2079 - DNA, 20 bp, Artificial sequence
  Synthetic oligonucleotide
cgggctttaatttcctttca

SEQ ID NO: 2080 - DNA, 20 bp, Artificial sequence
  Synthetic oligonucleotide
ctgagctgaaatcccatccc

SEQ ID NO: 2081 - DNA, 20 bp, Artificial sequence
  Synthetic oligonucleotide
gtccttctcttttcgcaccc

SEQ ID NO: 2082 - DNA, 20 bp, Artificial sequence
  Synthetic oligonucleotide
gcatccacatctgttgtgtt

SEQ ID NO: 2083 - DNA, 20 bp, Artificial sequence
  Synthetic oligonucleotide
gcttgtcacaatactgccac

SEQ ID NO: 2084 - DNA, 20 bp, Artificial sequence
  Synthetic oligonucleotide
atcaattgcattccaaggct

SEQ ID NO: 2085 - DNA, 20 bp, Artificial sequence
  Synthetic oligonucleotide
gcggaattcctcaaggcaca

SEQ ID NO: 2086 - DNA, 20 bp, Artificial sequence
  Synthetic oligonucleotide
tgtttctccctatatacact

SEQ ID NO: 2087 - DNA, 20 bp, Artificial sequence
  Synthetic oligonucleotide
tggatgtcttcctctggttc

SEQ ID NO: 2088 - DNA, 20 bp, Artificial sequence
  Synthetic oligonucleotide
atgtcatgctctccatggaa

SEQ ID NO: 2089 - DNA, 20 bp, Artificial sequence
  Synthetic oligonucleotide
cctccatgtacttcctctaa

SEQ ID NO: 2090 - DNA, 20 bp, Artificial sequence
  Synthetic oligonucleotide
ccaacttcacagtactcact

SEQ ID NO: 2091 - DNA, 20 bp, Artificial sequence
  Synthetic oligonucleotide
ctttgttccatcactctagc

SEQ ID NO: 2092 - DNA, 20 bp, Artificial sequence
  Synthetic oligonucleotide
ttgcgatcctcaactctact

SEQ ID NO: 2093 - DNA, 20 bp, Artificial sequence
  Synthetic oligonucleotide
tggagattacacatcccaca

SEQ ID NO: 2094 - DNA, 20 bp, Artificial sequence
  Synthetic oligonucleotide
atccttatttacaacctgcc

SEQ ID NO: 2095 - DNA, 20 bp, Artificial sequence
  Synthetic oligonucleotide
agtctgtgtctgctccgccc

SEQ ID NO: 2096 - DNA, 20 bp, Artificial sequence
  Synthetic oligonucleotide
ggtctaatccatcactgtct

SEQ ID NO: 2097 - DNA, 20 bp, Artificial sequence
  Synthetic oligonucleotide
gtctatgcttttctaagact

SEQ ID NO: 2098 - DNA, 20 bp, Artificial sequence
  Synthetic oligonucleotide
tcattttctatgcatccatc

SEQ ID NO: 2099 - DNA, 20 bp, Artificial sequence
  Synthetic oligonucleotide
cttccactgcacctagccct

SEQ ID NO: 2100 - DNA, 20 bp, Artificial sequence
  Synthetic oligonucleotide
ctctacatactctaccaggt

SEQ ID NO: 2101 - DNA, 20 bp, Artificial sequence
  Synthetic oligonucleotide
ctgtttcgcatacacagtac

SEQ ID NO: 2102 - DNA, 20 bp, Artificial sequence
  Synthetic oligonucleotide
aggcacatctaccatcacac

SEQ ID NO: 2103 - DNA, 20 bp, Artificial sequence
  Synthetic oligonucleotide
catcttaatcactcctcact

SEQ ID NO: 2104 - DNA, 20 bp, Artificial sequence
  Synthetic oligonucleotide
ttggtacttttctatcggtt

SEQ ID NO: 2105 - DNA, 20 bp, Artificial sequence
  Synthetic oligonucleotide
tcacctatcatctaggacct

SEQ ID NO: 2106 - DNA, 20 bp, Artificial sequence
  Synthetic oligonucleotide
tagcttgatcaatcacagct

SEQ ID NO: 2107 - DNA, 20 bp, Artificial sequence
  Synthetic oligonucleotide
ggccaattttgatccttgtc

SEQ ID NO: 2108 - DNA, 20 bp, Artificial sequence
  Synthetic oligonucleotide
aagttcttattaccatagct

SEQ ID NO: 2109 - DNA, 20 bp, Artificial sequence
  Synthetic oligonucleotide
gctactctgatttacttcaa

SEQ ID NO: 2110 - DNA, 20 bp, Artificial sequence
  Synthetic oligonucleotide
gcctgtcctcttctaatcaa

SEQ ID NO: 2111 - DNA, 20 bp, Artificial sequence
  Synthetic oligonucleotide
ccagtaaaccactttctggc

SEQ ID NO: 2112 - DNA, 20 bp, Artificial sequence
  Synthetic oligonucleotide
tgtttcctcttatcaggccc

SEQ ID NO: 2113 - DNA, 20 bp, Artificial sequence
  Synthetic oligonucleotide
ttatttcacattctcttctt

SEQ ID NO: 2114 - DNA, 20 bp, Artificial sequence
  Synthetic oligonucleotide
gcaccaattctctagcacac

SEQ ID NO: 2115 - DNA, 20 bp, Artificial sequence
  Synthetic oligonucleotide
ccccattgacctatctatgc

SEQ ID NO: 2116 - DNA, 20 bp, Artificial sequence
  Synthetic oligonucleotide
tctcatcccattgttcctta

SEQ ID NO: 2117 - DNA, 20 bp, Artificial sequence
  Synthetic oligonucleotide
ctgcctgtcctcttctaatc

SEQ ID NO: 2118 - DNA, 20 bp, Artificial sequence
  Synthetic oligonucleotide
gctagggctttcttttctca

SEQ ID NO: 2119 - DNA, 20 bp, Artificial sequence
  Synthetic oligonucleotide
agcgcagccactccctggca

SEQ ID NO: 2120 - DNA, 20 bp, Artificial sequence
  Synthetic oligonucleotide
tctctcatcatcccagatct

SEQ ID NO: 2121 - DNA, 20 bp, Artificial sequence
  Synthetic oligonucleotide
ctcacctatcatctaggacc

SEQ ID NO: 2122 - DNA, 20 bp, Artificial sequence
  Synthetic oligonucleotide
tggatttcaacctcacccct

SEQ ID NO: 2123 - DNA, 20 bp, Artificial sequence
  Synthetic oligonucleotide
ggcaacacaatctcttttgc

SEQ ID NO: 2124 - DNA, 20 bp, Artificial sequence
  Synthetic oligonucleotide
gccctcactcgatctttcta

SEQ ID NO: 2125 - DNA, 20 bp, Artificial sequence
  Synthetic oligonucleotide
gtgtgctcattccttcccct

SEQ ID NO: 2126 - DNA, 20 bp, Artificial sequence
  Synthetic oligonucleotide
catgctctacatactctacc

SEQ ID NO: 2127 - DNA, 20 bp, Artificial sequence
  Synthetic oligonucleotide
ccaagttcattcccctagcc

SEQ ID NO: 2128 - DNA, 20 bp, Artificial sequence
  Synthetic oligonucleotide
cccagcaaaccacttctgta

SEQ ID NO: 2129 - DNA, 20 bp, Artificial sequence
  Synthetic oligonucleotide
gctgcacaattattgtttcc

SEQ ID NO: 2130 - DNA, 20 bp, Artificial sequence
  Synthetic oligonucleotide
tgctactgcaatcacactcc

SEQ ID NO: 2131 - DNA, 20 bp, Artificial sequence
  Synthetic oligonucleotide
ctcactttcttacatgcggt

SEQ ID NO: 2132 - DNA, 20 bp, Artificial sequence
  Synthetic oligonucleotide
agagctttttctatctcctt

SEQ ID NO: 2133 - DNA, 20 bp, Artificial sequence
  Synthetic oligonucleotide
ttggagattacacatcccac

SEQ ID NO: 2134 - DNA, 20 bp, Artificial sequence
  Synthetic oligonucleotide
ccatcttaatcactcctcac

SEQ ID NO: 2135 - DNA, 20 bp, Artificial sequence
  Synthetic oligonucleotide
gccaacttcacagtactcac

SEQ ID NO: 2136 - DNA, 20 bp, Artificial sequence
  Synthetic oligonucleotide
acccaatgtctttttaggca

SEQ ID NO: 2137 - DNA, 20 bp, Artificial sequence
  Synthetic oligonucleotide
gcatctacttgtgttacagc

SEQ ID NO: 2138 - DNA, 20 bp, Artificial sequence
  Synthetic oligonucleotide
tgtggtatctactatcactt

SEQ ID NO: 2139 - DNA, 20 bp, Artificial sequence
  Synthetic oligonucleotide
ctcattttctatgcatccat

SEQ ID NO: 2140 - DNA, 20 bp, Artificial sequence
  Synthetic oligonucleotide
gcctgccgttaccaatgcca

SEQ ID NO: 2141 - DNA, 20 bp, Artificial sequence
  Synthetic oligonucleotide
ggcctgactctctcactccc

SEQ ID NO: 2142 - DNA, 20 bp, Artificial sequence
  Synthetic oligonucleotide
aaactcatcttctactgcag

SEQ ID NO: 2143 - DNA, 20 bp, Artificial sequence
  Synthetic oligonucleotide
cttccaaatatacagtggca

SEQ ID NO: 2144 - DNA, 20 bp, Artificial sequence
  Synthetic oligonucleotide
tagtctgtgtctgctccgcc

SEQ ID NO: 2145 - DNA, 20 bp, Artificial sequence
  Synthetic oligonucleotide
tgcccatcatccatccctgc

SEQ ID NO: 2146 - DNA, 20 bp, Artificial sequence
  Synthetic oligonucleotide
tccatctttattctatgagc

SEQ ID NO: 2147 - DNA, 20 bp, Artificial sequence
  Synthetic oligonucleotide
gcatcatttttgctccccat

SEQ ID NO: 2148 - DNA, 20 bp, Artificial sequence
  Synthetic oligonucleotide
gtctgtttctccctatatac

SEQ ID NO: 2149 - DNA, 20 bp, Artificial sequence
  Synthetic oligonucleotide
gcctttgttttttaatccaa

SEQ ID NO: 2150 - DNA, 20 bp, Artificial sequence
  Synthetic oligonucleotide
gtccacaatctccacagaca

SEQ ID NO: 2151 - DNA, 20 bp, Artificial sequence
  Synthetic oligonucleotide
gtgctgatctgatttccaac

SEQ ID NO: 2152 - DNA, 20 bp, Artificial sequence
  Synthetic oligonucleotide
ggtccttctcttttcgcacc

SEQ ID NO: 2153 - DNA, 20 bp, Artificial sequence
  Synthetic oligonucleotide
acaccactccctcaagctgt

SEQ ID NO: 2154 - DNA, 20 bp, Artificial sequence
  Synthetic oligonucleotide
tgcggaattcctcaaggcac

SEQ ID NO: 2155 - DNA, 20 bp, Artificial sequence
  Synthetic oligonucleotide
tgcaaccattttattgttca

SEQ ID NO: 2156 - DNA, 20 bp, Artificial sequence
  Synthetic oligonucleotide
catcatgacttcttcaggca

SEQ ID NO: 2157 - DNA, 20 bp, Artificial sequence
  Synthetic oligonucleotide
tcatccatcatgcatgcttc

SEQ ID NO: 2158 - DNA, 20 bp, Artificial sequence
  Synthetic oligonucleotide
tgccaccaccctcaatactt

SEQ ID NO: 2159 - DNA, 20 bp, Artificial sequence
  Synthetic oligonucleotide
tgttccttcttacattggca

SEQ ID NO: 2160 - DNA, 20 bp, Artificial sequence
  Synthetic oligonucleotide
gtggtttttcctcaaccttt

SEQ ID NO: 2161 - DNA, 20 bp, Artificial sequence
  Synthetic oligonucleotide
gactcatttctacctccctc

SEQ ID NO: 2162 - DNA, 20 bp, Artificial sequence
  Synthetic oligonucleotide
cctgttctttgactatcgcc

SEQ ID NO: 2163 - DNA, 20 bp, Artificial sequence
  Synthetic oligonucleotide
acccacccacacttttggct

SEQ ID NO: 2164 - DNA, 20 bp, Artificial sequence
  Synthetic oligonucleotide
ggtctatatatttcaggcat

SEQ ID NO: 2165 - DNA, 20 bp, Artificial sequence
  Synthetic oligonucleotide
agcactccagtaaaccactt

SEQ ID NO: 2166 - DNA, 20 bp, Artificial sequence
  Synthetic oligonucleotide
tctcactttatccattcata

SEQ ID NO: 2167 - DNA, 20 bp, Artificial sequence
  Synthetic oligonucleotide
gaggtcttatagattctacc

SEQ ID NO: 2168 - DNA, 20 bp, Artificial sequence
  Synthetic oligonucleotide
ccacaatgcttttcacacta

SEQ ID NO: 2169 - DNA, 20 bp, Artificial sequence
  Synthetic oligonucleotide
atggttgtatcccaatgctt

SEQ ID NO: 2170 - DNA, 20 bp, Artificial sequence
  Synthetic oligonucleotide
cctgagctgaaatcccatcc

SEQ ID NO: 2171 - DNA, 20 bp, Artificial sequence
  Synthetic oligonucleotide
gtccattacaaacaagtaac

SEQ ID NO: 2172 - DNA, 20 bp, Artificial sequence
  Synthetic oligonucleotide
cagcattcagaacttcctgc

SEQ ID NO: 2173 - DNA, 20 bp, Artificial sequence
  Synthetic oligonucleotide
acagggtctaatccatcact

SEQ ID NO: 2174 - DNA, 20 bp, Artificial sequence
  Synthetic oligonucleotide
ttagatatttctatacatca

SEQ ID NO: 2175 - DNA, 20 bp, Artificial sequence
  Synthetic oligonucleotide
tgctcatactatacctctga

SEQ ID NO: 2176 - DNA, 20 bp, Artificial sequence
  Synthetic oligonucleotide
attctgcatccatcttcact

SEQ ID NO: 2177 - DNA, 20 bp, Artificial sequence
  Synthetic oligonucleotide
acagtgcttatgctatgcca

SEQ ID NO: 2178 - DNA, 20 bp, Artificial sequence
  Synthetic oligonucleotide
ctcaaggtttctatccagct

SEQ ID NO: 2179 - DNA, 20 bp, Artificial sequence
  Synthetic oligonucleotide
gggaaagatttacattctac

SEQ ID NO: 2180 - DNA, 20 bp, Artificial sequence
  Synthetic oligonucleotide
ggtctctgctcccagagctt

SEQ ID NO: 2181 - DNA, 20 bp, Artificial sequence
  Synthetic oligonucleotide
tccacatcatatagtggcga

SEQ ID NO: 2182 - DNA, 20 bp, Artificial sequence
  Synthetic oligonucleotide
ctgtattatttcttttacgc

SEQ ID NO: 2183 - DNA, 20 bp, Artificial sequence
  Synthetic oligonucleotide
tgctttgttccatcactcta

SEQ ID NO: 2184 - DNA, 20 bp, Artificial sequence
  Synthetic oligonucleotide
gctacacctgatgacagcaa

SEQ ID NO: 2185 - DNA, 20 bp, Artificial sequence
  Synthetic oligonucleotide
tgtcttctactcttcttgct

SEQ ID NO: 2186 - DNA, 20 bp, Artificial sequence
  Synthetic oligonucleotide
agtcatctatcatctgttct

SEQ ID NO: 2187 - DNA, 20 bp, Artificial sequence
  Synthetic oligonucleotide
ttcaacttagtcatcctctt

SEQ ID NO: 2188 - DNA, 20 bp, Artificial sequence
  Synthetic oligonucleotide
gccatatctttcaatcctgc

SEQ ID NO: 2189 - DNA, 20 bp, Artificial sequence
  Synthetic oligonucleotide
tagattttcaattcctgtca

SEQ ID NO: 2190 - DNA, 20 bp, Artificial sequence
  Synthetic oligonucleotide
gcaccttcagaattctccct

SEQ ID NO: 2191 - DNA, 20 bp, Artificial sequence
  Synthetic oligonucleotide
gctcatacctcacatgtggc

SEQ ID NO: 2192 - DNA, 20 bp, Artificial sequence
  Synthetic oligonucleotide
gctctcactttcttacatgc

SEQ ID NO: 2193 - DNA, 20 bp, Artificial sequence
  Synthetic oligonucleotide
tcttcaacttagtcatcctc

SEQ ID NO: 2194 - DNA, 20 bp, Artificial sequence
  Synthetic oligonucleotide
ccacactcagaacttccttc

SEQ ID NO: 2195 - DNA, 20 bp, Artificial sequence
  Synthetic oligonucleotide
gggactcatttctacctccc

SEQ ID NO: 2196 - DNA, 20 bp, Artificial sequence
  Synthetic oligonucleotide
gagacatcatactttctagt

SEQ ID NO: 2197 - DNA, 20 bp, Artificial sequence
  Synthetic oligonucleotide
gcagaggttttaattgctga

SEQ ID NO: 2198 - DNA, 20 bp, Artificial sequence
  Synthetic oligonucleotide
ctgtcttctactcttcttgc

SEQ ID NO: 2199 - DNA, 20 bp, Artificial sequence
  Synthetic oligonucleotide
ggcaccaattctctagcaca

SEQ ID NO: 2200 - DNA, 20 bp, Artificial sequence
  Synthetic oligonucleotide
tgcttttcttcttatacaac

SEQ ID NO: 2201 - DNA, 20 bp, Artificial sequence
  Synthetic oligonucleotide
atccagctcctcactggctt

SEQ ID NO: 2202 - DNA, 20 bp, Artificial sequence
  Synthetic oligonucleotide
ccatatattacatagatctc

SEQ ID NO: 2203 - DNA, 20 bp, Artificial sequence
  Synthetic oligonucleotide
gtacaatctatatctcgccc

SEQ ID NO: 2204 - DNA, 20 bp, Artificial sequence
  Synthetic oligonucleotide
gagggacatactcctcagca

SEQ ID NO: 2205 - DNA, 20 bp, Artificial sequence
  Synthetic oligonucleotide
acccattgtacatcaacatc

SEQ ID NO: 2206 - DNA, 20 bp, Artificial sequence
  Synthetic oligonucleotide
tctcacctatcatctaggac

SEQ ID NO: 2207 - DNA, 20 bp, Artificial sequence
  Synthetic oligonucleotide
gctcaactcatctaacaggc

SEQ ID NO: 2208 - DNA, 20 bp, Artificial sequence
  Synthetic oligonucleotide
tcatcatgacttcttcaggc

SEQ ID NO: 2209 - DNA, 20 bp, Artificial sequence
  Synthetic oligonucleotide
ctggatttcaacctcacccc

SEQ ID NO: 2210 - DNA, 20 bp, Artificial sequence
  Synthetic oligonucleotide
aggcatgcatttttagggac

SEQ ID NO: 2211 - DNA, 20 bp, Artificial sequence
  Synthetic oligonucleotide
gcaccatcccactaagactc

SEQ ID NO: 2212 - DNA, 20 bp, Artificial sequence
  Synthetic oligonucleotide
tgtggtttttcctcaacctt

SEQ ID NO: 2213 - DNA, 20 bp, Artificial sequence
  Synthetic oligonucleotide
atggtgctacttccccttca

SEQ ID NO: 2214 - DNA, 20 bp, Artificial sequence
  Synthetic oligonucleotide
tggtgcctttacacagctgc

SEQ ID NO: 2215 - DNA, 20 bp, Artificial sequence
  Synthetic oligonucleotide
gtgcttatccatctttattc

SEQ ID NO: 2216 - DNA, 20 bp, Artificial sequence
  Synthetic oligonucleotide
gccagaagtttcaccaactc

SEQ ID NO: 2217 - DNA, 20 bp, Artificial sequence
  Synthetic oligonucleotide
actggattctgacactgtac

SEQ ID NO: 2218 - DNA, 20 bp, Artificial sequence
  Synthetic oligonucleotide
tgttttcacttatatcggta

SEQ ID NO: 2219 - DNA, 20 bp, Artificial sequence
  Synthetic oligonucleotide
tggcctgactctctcactcc

SEQ ID NO: 2220 - DNA, 20 bp, Artificial sequence
  Synthetic oligonucleotide
ccttcccattcactatctgt

SEQ ID NO: 2221 - DNA, 20 bp, Artificial sequence
  Synthetic oligonucleotide
aatcaatcaccaatgctggc

SEQ ID NO: 2222 - DNA, 20 bp, Artificial sequence
  Synthetic oligonucleotide
cctcattttctatgcatcca

SEQ ID NO: 2223 - DNA, 20 bp, Artificial sequence
  Synthetic oligonucleotide
accaagttcattcccctagc

SEQ ID NO: 2224 - DNA, 20 bp, Artificial sequence
  Synthetic oligonucleotide
ttgccccattgacctatcta

SEQ ID NO: 2225 - DNA, 20 bp, Artificial sequence
  Synthetic oligonucleotide
gttcacagtttaccccaagc

SEQ ID NO: 2226 - DNA, 20 bp, Artificial sequence
  Synthetic oligonucleotide
atcttccttagactatgcct

SEQ ID NO: 2227 - DNA, 20 bp, Artificial sequence
  Synthetic oligonucleotide
gaaactcatcttctactgca

SEQ ID NO: 2228 - DNA, 20 bp, Artificial sequence
  Synthetic oligonucleotide
gcttccaaatatacagtggc

SEQ ID NO: 2229 - DNA, 20 bp, Artificial sequence
  Synthetic oligonucleotide
gattatttcacattctcttc

SEQ ID NO: 2230 - DNA, 20 bp, Artificial sequence
  Synthetic oligonucleotide
cctctggttttaccagtact

SEQ ID NO: 2231 - DNA, 20 bp, Artificial sequence
  Synthetic oligonucleotide
ccagatattactttcttcat

SEQ ID NO: 2232 - DNA, 20 bp, Artificial sequence
  Synthetic oligonucleotide
gcatgctctacatactctac

SEQ ID NO: 2233 - DNA, 20 bp, Artificial sequence
  Synthetic oligonucleotide
agtgaactagttcctacctt

SEQ ID NO: 2234 - DNA, 20 bp, Artificial sequence
  Synthetic oligonucleotide
agatcagatttctcaacccc

SEQ ID NO: 2235 - DNA, 20 bp, Artificial sequence
  Synthetic oligonucleotide
atgatctcatcccattgttc

SEQ ID NO: 2236 - DNA, 20 bp, Artificial sequence
  Synthetic oligonucleotide
ttgcatttaaattttctgga

SEQ ID NO: 2237 - DNA, 20 bp, Artificial sequence
  Synthetic oligonucleotide
acctaattatttctccgtct

SEQ ID NO: 2238 - DNA, 20 bp, Artificial sequence
  Synthetic oligonucleotide
cctccagcatatcctgggat

SEQ ID NO: 2239 - DNA, 20 bp, Artificial sequence
  Synthetic oligonucleotide
ttgctttgttccatcactct

SEQ ID NO: 2240 - DNA, 20 bp, Artificial sequence
  Synthetic oligonucleotide
gtcctacctgcctttctctc

SEQ ID NO: 2241 - DNA, 20 bp, Artificial sequence
  Synthetic oligonucleotide
ccaggttccttctccaggct

SEQ ID NO: 2242 - DNA, 20 bp, Artificial sequence
  Synthetic oligonucleotide
ggcatctacttgtgttacag

SEQ ID NO: 2243 - DNA, 20 bp, Artificial sequence
  Synthetic oligonucleotide
cctcatcataaccatttgta

SEQ ID NO: 2244 - DNA, 20 bp, Artificial sequence
  Synthetic oligonucleotide
tcggaattctgcatccatct

SEQ ID NO: 2245 - DNA, 20 bp, Artificial sequence
  Synthetic oligonucleotide
cctgctcttattccaagtaa

SEQ ID NO: 2246 - DNA, 20 bp, Artificial sequence
  Synthetic oligonucleotide
cggcatcctcacctgcatca

SEQ ID NO: 2247 - DNA, 20 bp, Artificial sequence
  Synthetic oligonucleotide
cagccctcactcgatctttc

SEQ ID NO: 2248 - DNA, 20 bp, Artificial sequence
  Synthetic oligonucleotide
gcaaagatttgaatctggac

SEQ ID NO: 2249 - DNA, 20 bp, Artificial sequence
  Synthetic oligonucleotide
accatcttaatcactcctca

SEQ ID NO: 2250 - DNA, 20 bp, Artificial sequence
  Synthetic oligonucleotide
ccattcatttgacaaagcat

SEQ ID NO: 2251 - DNA, 20 bp, Artificial sequence
  Synthetic oligonucleotide
gcagactctcagtcttcatc

SEQ ID NO: 2252 - DNA, 20 bp, Artificial sequence
  Synthetic oligonucleotide
ctaggagtcatctatcatct

SEQ ID NO: 2253 - DNA, 20 bp, Artificial sequence
  Synthetic oligonucleotide
ctgtatctcattatatggct

SEQ ID NO: 2254 - DNA, 20 bp, Artificial sequence
  Synthetic oligonucleotide
tcctgatgactctacagcaa

SEQ ID NO: 2255 - DNA, 20 bp, Artificial sequence
  Synthetic oligonucleotide
gcatacacattcatcttgac

SEQ ID NO: 2256 - DNA, 20 bp, Artificial sequence
  Synthetic oligonucleotide
actcagtcaacatccatgct

SEQ ID NO: 2257 - DNA, 20 bp, Artificial sequence
  Synthetic oligonucleotide
atgccaacttcacagtactc

SEQ ID NO: 2258 - DNA, 20 bp, Artificial sequence
  Synthetic oligonucleotide
atagtctgtgtctgctccgc

SEQ ID NO: 2259 - DNA, 20 bp, Artificial sequence
  Synthetic oligonucleotide
gaacagggtctaatccatca

SEQ ID NO: 2260 - DNA, 20 bp, Artificial sequence
  Synthetic oligonucleotide
gttaagttatcatattgtct

SEQ ID NO: 2261 - DNA, 20 bp, Artificial sequence
  Synthetic oligonucleotide
ttggtctatatatttcaggc

SEQ ID NO: 2262 - DNA, 20 bp, Artificial sequence
  Synthetic oligonucleotide
gctgcttttcacttccacaa

SEQ ID NO: 2263 - DNA, 20 bp, Artificial sequence
  Synthetic oligonucleotide
tcagacacagcactccagta

SEQ ID NO: 2264 - DNA, 20 bp, Artificial sequence
  Synthetic oligonucleotide
tgggcatcatttttgctccc

SEQ ID NO: 2265 - DNA, 20 bp, Artificial sequence
  Synthetic oligonucleotide
agctgcacaattattgtttc

SEQ ID NO: 2266 - DNA, 20 bp, Artificial sequence
  Synthetic oligonucleotide
gggctgatattctcacttta

SEQ ID NO: 2267 - DNA, 20 bp, Artificial sequence
  Synthetic oligonucleotide
ccagcttttcctttcacatc

SEQ ID NO: 2268 - DNA, 20 bp, Artificial sequence
  Synthetic oligonucleotide
gctactcttcaacttagtca

SEQ ID NO: 2269 - DNA, 20 bp, Artificial sequence
  Synthetic oligonucleotide
atccacactcagaacttcct

SEQ ID NO: 2270 - DNA, 20 bp, Artificial sequence
  Synthetic oligonucleotide
gcatgctactactgaggcct

SEQ ID NO: 2271 - DNA, 20 bp, Artificial sequence
  Synthetic oligonucleotide
gttccatcaacaaagggcta

SEQ ID NO: 2272 - DNA, 20 bp, Artificial sequence
  Synthetic oligonucleotide
accatatattacatagatct

SEQ ID NO: 2273 - DNA, 20 bp, Artificial sequence
  Synthetic oligonucleotide
gctgcctttacattcaaaca

SEQ ID NO: 2274 - DNA, 20 bp, Artificial sequence
  Synthetic oligonucleotide
gtagtagccttcccttcctt

SEQ ID NO: 2275 - DNA, 20 bp, Artificial sequence
  Synthetic oligonucleotide
agcatgtataccattcagca

SEQ ID NO: 2276 - DNA, 20 bp, Artificial sequence
  Synthetic oligonucleotide
gtcctttataacccattgac

SEQ ID NO: 2277 - DNA, 20 bp, Artificial sequence
  Synthetic oligonucleotide
aaggcatgcatttttaggga

SEQ ID NO: 2278 - DNA, 20 bp, Artificial sequence
  Synthetic oligonucleotide
aaccatcttaatcactcctc

SEQ ID NO: 2279 - DNA, 20 bp, Artificial sequence
  Synthetic oligonucleotide
ccgttcctgctcatacctca

SEQ ID NO: 2280 - DNA, 20 bp, Artificial sequence
  Synthetic oligonucleotide
accaaagctttcatcatgac

SEQ ID NO: 2281 - DNA, 20 bp, Artificial sequence
  Synthetic oligonucleotide
cagagtttcatcttacccaa

SEQ ID NO: 2282 - DNA, 20 bp, Artificial sequence
  Synthetic oligonucleotide
cctcctctattatagccttt

SEQ ID NO: 2283 - DNA, 20 bp, Artificial sequence
  Synthetic oligonucleotide
catgtcggaattctgcatcc

SEQ ID NO: 2284 - DNA, 20 bp, Artificial sequence
  Synthetic oligonucleotide
ctgcaactatgaacagggtc

SEQ ID NO: 2285 - DNA, 20 bp, Artificial sequence
  Synthetic oligonucleotide
ggattatttcacattctctt

SEQ ID NO: 2286 - DNA, 20 bp, Artificial sequence
  Synthetic oligonucleotide
ggcatgctctacatactcta

SEQ ID NO: 2287 - DNA, 20 bp, Artificial sequence
  Synthetic oligonucleotide
catagtctgtgtctgctccg

SEQ ID NO: 2288 - DNA, 20 bp, Artificial sequence
  Synthetic oligonucleotide
ggctgcttttcacttccaca

SEQ ID NO: 2289 - DNA, 20 bp, Artificial sequence
  Synthetic oligonucleotide
gccagtgtataaacttgctc

SEQ ID NO: 2290 - DNA, 20 bp, Artificial sequence
  Synthetic oligonucleotide
atgttttcacttatatcggt

SEQ ID NO: 2291 - DNA, 20 bp, Artificial sequence
  Synthetic oligonucleotide
tctgcttttcttcttataca

SEQ ID NO: 2292 - DNA, 20 bp, Artificial sequence
  Synthetic oligonucleotide
gtggtggtactctaccaaca

SEQ ID NO: 2293 - DNA, 20 bp, Artificial sequence
  Synthetic oligonucleotide
tgtacaatctatatctcgcc

SEQ ID NO: 2294 - DNA, 20 bp, Artificial sequence
  Synthetic oligonucleotide
cctccccctatctctcacta

SEQ ID NO: 2295 - DNA, 20 bp, Artificial sequence
  Synthetic oligonucleotide
ctgtggtttttcctcaacct

SEQ ID NO: 2296 - DNA, 20 bp, Artificial sequence
  Synthetic oligonucleotide
ctgcaattccccaaggtgct

SEQ ID NO: 2297 - DNA, 20 bp, Artificial sequence
  Synthetic oligonucleotide
gtccataccctttaatatct

SEQ ID NO: 2298 - DNA, 20 bp, Artificial sequence
  Synthetic oligonucleotide
tatttcaatatacagtgtat

SEQ ID NO: 2299 - DNA, 20 bp, Artificial sequence
  Synthetic oligonucleotide
ctggcctgactctctcactc

SEQ ID NO: 2300 - DNA, 20 bp, Artificial sequence
  Synthetic oligonucleotide
tggctacatcctcaattcat

SEQ ID NO: 2301 - DNA, 20 bp, Artificial sequence
  Synthetic oligonucleotide
gcatgtgtcctacctgcctt

SEQ ID NO: 2302 - DNA, 20 bp, Artificial sequence
  Synthetic oligonucleotide
gccagatcatttcacgatct

SEQ ID NO: 2303 - DNA, 20 bp, Artificial sequence
  Synthetic oligonucleotide
gaccaattacctcttctttt

SEQ ID NO: 2304 - DNA, 20 bp, Artificial sequence
  Synthetic oligonucleotide
gcagggcatattcctggtgc

SEQ ID NO: 2305 - DNA, 20 bp, Artificial sequence
  Synthetic oligonucleotide
cctggatttcaacctcaccc

SEQ ID NO: 2306 - DNA, 20 bp, Artificial sequence
  Synthetic oligonucleotide
cactgctgtccacacagggc

SEQ ID NO: 2307 - DNA, 20 bp, Artificial sequence
  Synthetic oligonucleotide
ctcttgttaaatcatggcat

SEQ ID NO: 2308 - DNA, 20 bp, Artificial sequence
  Synthetic oligonucleotide
gccaatcaatcaccaatgct

SEQ ID NO: 2309 - DNA, 20 bp, Artificial sequence
  Synthetic oligonucleotide
ttgggcatcatttttgctcc

SEQ ID NO: 2310 - DNA, 20 bp, Artificial sequence
  Synthetic oligonucleotide
cccagctttccacaaagacc

SEQ ID NO: 2311 - DNA, 20 bp, Artificial sequence
  Synthetic oligonucleotide
gtgggctgatattctcactt

SEQ ID NO: 2312 - DNA, 20 bp, Artificial sequence
  Synthetic oligonucleotide
tctgatccccttcataccct

SEQ ID NO: 2313 - DNA, 20 bp, Artificial sequence
  Synthetic oligonucleotide
aggtctgtaacctcaagtct

SEQ ID NO: 2314 - DNA, 20 bp, Artificial sequence
  Synthetic oligonucleotide
ttcctagtacatcactgctt

SEQ ID NO: 2315 - DNA, 20 bp, Artificial sequence
  Synthetic oligonucleotide
gcatgcttaacttcaaggtt

SEQ ID NO: 2316 - DNA, 20 bp, Artificial sequence
  Synthetic oligonucleotide
gttggtctatatatttcagg

SEQ ID NO: 2317 - DNA, 20 bp, Artificial sequence
  Synthetic oligonucleotide
atgccatcagtctcttctca

SEQ ID NO: 2318 - DNA, 20 bp, Artificial sequence
  Synthetic oligonucleotide
gctactacatatcacttttc

SEQ ID NO: 2319 - DNA, 20 bp, Artificial sequence
  Synthetic oligonucleotide
tcaccacctttattgtcttt

SEQ ID NO: 2320 - DNA, 20 bp, Artificial sequence
  Synthetic oligonucleotide
gcacaaatctagattagcat

SEQ ID NO: 2321 - DNA, 20 bp, Artificial sequence
  Synthetic oligonucleotide
ttctcacctatcatctagga

SEQ ID NO: 2322 - DNA, 20 bp, Artificial sequence
  Synthetic oligonucleotide
gcacatcataatcctgagtt

SEQ ID NO: 2323 - DNA, 20 bp, Artificial sequence
  Synthetic oligonucleotide
gatccatcacatctaggcat

SEQ ID NO: 2324 - DNA, 20 bp, Artificial sequence
  Synthetic oligonucleotide
acggcatcctcacctgcatc

SEQ ID NO: 2325 - DNA, 20 bp, Artificial sequence
  Synthetic oligonucleotide
caggcatctacttgtgttac

SEQ ID NO: 2326 - DNA, 20 bp, Artificial sequence
  Synthetic oligonucleotide
ggtgcatacacattcatctt

SEQ ID NO: 2327 - DNA, 20 bp, Artificial sequence
  Synthetic oligonucleotide
ccccaatttccatcagcagc

SEQ ID NO: 2328 - DNA, 20 bp, Artificial sequence
  Synthetic oligonucleotide
ctaccttcatttttatagca

SEQ ID NO: 2329 - DNA, 20 bp, Artificial sequence
  Synthetic oligonucleotide
tgaacaactcaacatctcca

SEQ ID NO: 2330 - DNA, 20 bp, Artificial sequence
  Synthetic oligonucleotide
acacatgcatctcccatgac

SEQ ID NO: 2331 - DNA, 20 bp, Artificial sequence
  Synthetic oligonucleotide
tgcctcattttctatgcatc

SEQ ID NO: 2332 - DNA, 20 bp, Artificial sequence
  Synthetic oligonucleotide
tggatggttttctcccacca

SEQ ID NO: 2333 - DNA, 20 bp, Artificial sequence
  Synthetic oligonucleotide
acagccctcactcgatcttt

SEQ ID NO: 2334 - DNA, 20 bp, Artificial sequence
  Synthetic oligonucleotide
tccactttcttctttgattc

SEQ ID NO: 2335 - DNA, 20 bp, Artificial sequence
  Synthetic oligonucleotide
atcatgtaatactcagacac

SEQ ID NO: 2336 - DNA, 20 bp, Artificial sequence
  Synthetic oligonucleotide
cctgggatataaacctggct

SEQ ID NO: 2337 - DNA, 20 bp, Artificial sequence
  Synthetic oligonucleotide
gtttgccccattgacctatc

SEQ ID NO: 2338 - DNA, 20 bp, Artificial sequence
  Synthetic oligonucleotide
ccgcaacgcattgcacggta

SEQ ID NO: 2339 - DNA, 20 bp, Artificial sequence
  Synthetic oligonucleotide
gctctagcttaaattggacc

SEQ ID NO: 2340 - DNA, 20 bp, Artificial sequence
  Synthetic oligonucleotide
cctatctttctgtactgcca

SEQ ID NO: 2341 - DNA, 20 bp, Artificial sequence
  Synthetic oligonucleotide
acagcagcaatttatagcag

SEQ ID NO: 2342 - DNA, 20 bp, Artificial sequence
  Synthetic oligonucleotide
gctgcaattccccaaggtgc

SEQ ID NO: 2343 - DNA, 20 bp, Artificial sequence
  Synthetic oligonucleotide
gcactggcctgactctctca

SEQ ID NO: 2344 - DNA, 20 bp, Artificial sequence
  Synthetic oligonucleotide
tgcttgtatttataagcaca

SEQ ID NO: 2345 - DNA, 20 bp, Artificial sequence
  Synthetic oligonucleotide
aggctattacctcccttcct

SEQ ID NO: 2346 - DNA, 20 bp, Artificial sequence
  Synthetic oligonucleotide
tagcaagattttatcgaact

SEQ ID NO: 2347 - DNA, 20 bp, Artificial sequence
  Synthetic oligonucleotide
gctccaccccaatttccatc

SEQ ID NO: 2348 - DNA, 20 bp, Artificial sequence
  Synthetic oligonucleotide
ggtttctttttctcacctat

SEQ ID NO: 2349 - DNA, 20 bp, Artificial sequence
  Synthetic oligonucleotide
taggacattcatttttgacc

SEQ ID NO: 2350 - DNA, 20 bp, Artificial sequence
  Synthetic oligonucleotide
cacacatgcatctcccatga

SEQ ID NO: 2351 - DNA, 20 bp, Artificial sequence
  Synthetic oligonucleotide
cgggcatttttcactctaaa

SEQ ID NO: 2352 - DNA, 20 bp, Artificial sequence
  Synthetic oligonucleotide
ggctactcttcaacttagtc

SEQ ID NO: 2353 - DNA, 20 bp, Artificial sequence
  Synthetic oligonucleotide
ctaaatcagttctcttgcta

SEQ ID NO: 2354 - DNA, 20 bp, Artificial sequence
  Synthetic oligonucleotide
cagcatgctactactgaggc

SEQ ID NO: 2355 - DNA, 20 bp, Artificial sequence
  Synthetic oligonucleotide
ctgcattcagccccttacct

SEQ ID NO: 2356 - DNA, 20 bp, Artificial sequence
  Synthetic oligonucleotide
tgtgtagcacatcataatcc

SEQ ID NO: 2357 - DNA, 20 bp, Artificial sequence
  Synthetic oligonucleotide
gatcatgtaatactcagaca

SEQ ID NO: 2358 - DNA, 20 bp, Artificial sequence
  Synthetic oligonucleotide
gcctggatttcaacctcacc

SEQ ID NO: 2359 - DNA, 20 bp, Artificial sequence
  Synthetic oligonucleotide
gccaagtattttcctgcatc

SEQ ID NO: 2360 - DNA, 20 bp, Artificial sequence
  Synthetic oligonucleotide
gctactgacataatacacat

SEQ ID NO: 2361 - DNA, 20 bp, Artificial sequence
  Synthetic oligonucleotide
tcccagacacagcactggca

SEQ ID NO: 2362 - DNA, 20 bp, Artificial sequence
  Synthetic oligonucleotide
tgcaatttttattaacacac

SEQ ID NO: 2363 - DNA, 20 bp, Artificial sequence
  Synthetic oligonucleotide
gaaccatcttaatcactcct

SEQ ID NO: 2364 - DNA, 20 bp, Artificial sequence
  Synthetic oligonucleotide
gtcaggcctacacctctgca

SEQ ID NO: 2365 - DNA, 20 bp, Artificial sequence
  Synthetic oligonucleotide
cctaccgtttaatttctttc

SEQ ID NO: 2366 - DNA, 20 bp, Artificial sequence
  Synthetic oligonucleotide
gctccaacaatctgcaactc

SEQ ID NO: 2367 - DNA, 20 bp, Artificial sequence
  Synthetic oligonucleotide
gctaagcttacgctaagggc

SEQ ID NO: 2368 - DNA, 20 bp, Artificial sequence
  Synthetic oligonucleotide
tctacatattatatctaggt

SEQ ID NO: 2369 - DNA, 20 bp, Artificial sequence
  Synthetic oligonucleotide
ctgtacaatctatatctcgc

SEQ ID NO: 2370 - DNA, 20 bp, Artificial sequence
  Synthetic oligonucleotide
gatatttcaatatacagtgt

SEQ ID NO: 2371 - DNA, 20 bp, Artificial sequence
  Synthetic oligonucleotide
acacagccctcactcgatct

SEQ ID NO: 2372 - DNA, 20 bp, Artificial sequence
  Synthetic oligonucleotide
ctgttcacagttccttgcac

SEQ ID NO: 2373 - DNA, 20 bp, Artificial sequence
  Synthetic oligonucleotide
cctagagcaatcattgtact

SEQ ID NO: 2374 - DNA, 20 bp, Artificial sequence
  Synthetic oligonucleotide
aggcatgctctacatactct

SEQ ID NO: 2375 - DNA, 20 bp, Artificial sequence
  Synthetic oligonucleotide
ttgcctcattttctatgcat

SEQ ID NO: 2376 - DNA, 20 bp, Artificial sequence
  Synthetic oligonucleotide
gtattcctatctttctgtac

SEQ ID NO: 2377 - DNA, 20 bp, Artificial sequence
  Synthetic oligonucleotide
tggcatcttatcataataga

SEQ ID NO: 2378 - DNA, 20 bp, Artificial sequence
  Synthetic oligonucleotide
cggattatttcacattctct

SEQ ID NO: 2379 - DNA, 20 bp, Artificial sequence
  Synthetic oligonucleotide
gcactagtttgatacagcta

SEQ ID NO: 2380 - DNA, 20 bp, Artificial sequence
  Synthetic oligonucleotide
gctttcaaagaacaagcaca

SEQ ID NO: 2381 - DNA, 20 bp, Artificial sequence
  Synthetic oligonucleotide
tggcattcattctttgtata

SEQ ID NO: 2382 - DNA, 20 bp, Artificial sequence
  Synthetic oligonucleotide
gacagcagcaatttatagca

SEQ ID NO: 2383 - DNA, 20 bp, Artificial sequence
  Synthetic oligonucleotide
gcttcttgactttacagcta

SEQ ID NO: 2384 - DNA, 20 bp, Artificial sequence
  Synthetic oligonucleotide
gatgatgaacttcatatcct

SEQ ID NO: 2385 - DNA, 20 bp, Artificial sequence
  Synthetic oligonucleotide
tctgcaactatgaacagggt

SEQ ID NO: 2386 - DNA, 20 bp, Artificial sequence
  Synthetic oligonucleotide
tccttttccaatatttggct

SEQ ID NO: 2387 - DNA, 20 bp, Artificial sequence
  Synthetic oligonucleotide
cttcatccctactttggtca

SEQ ID NO: 2388 - DNA, 20 bp, Artificial sequence
  Synthetic oligonucleotide
catccacactcagaacttcc

SEQ ID NO: 2389 - DNA, 20 bp, Artificial sequence
  Synthetic oligonucleotide
aggatccatcacatctaggc

SEQ ID NO: 2390 - DNA, 20 bp, Artificial sequence
  Synthetic oligonucleotide
ccacattgtccatacccttt

SEQ ID NO: 2391 - DNA, 20 bp, Artificial sequence
  Synthetic oligonucleotide
agcttcttttctcctacatt

SEQ ID NO: 2392 - DNA, 20 bp, Artificial sequence
  Synthetic oligonucleotide
agccagcttttcctttcaca

SEQ ID NO: 2393 - DNA, 20 bp, Artificial sequence
  Synthetic oligonucleotide
tcggcttcttcttcttccac

SEQ ID NO: 2394 - DNA, 20 bp, Artificial sequence
  Synthetic oligonucleotide
ttgttccatcaacaaagggc

SEQ ID NO: 2395 - DNA, 20 bp, Artificial sequence
  Synthetic oligonucleotide
agccaatcaatcaccaatgc

SEQ ID NO: 2396 - DNA, 20 bp, Artificial sequence
  Synthetic oligonucleotide
gctgatttgataaccacaat

SEQ ID NO: 2397 - DNA, 20 bp, Artificial sequence
  Synthetic oligonucleotide
agacacttttatcttgcact

SEQ ID NO: 2398 - DNA, 20 bp, Artificial sequence
  Synthetic oligonucleotide
gctcactcctacctccctta

SEQ ID NO: 2399 - DNA, 20 bp, Artificial sequence
  Synthetic oligonucleotide
tgttggtctatatatttcag

SEQ ID NO: 2400 - DNA, 20 bp, Artificial sequence
  Synthetic oligonucleotide
tgggtctgctatttctcgat

SEQ ID NO: 2401 - DNA, 20 bp, Artificial sequence
  Synthetic oligonucleotide
attgtcttaaagctcctggc

SEQ ID NO: 2402 - DNA, 20 bp, Artificial sequence
  Synthetic oligonucleotide
cgttttgattttttccctcc

SEQ ID NO: 2403 - DNA, 20 bp, Artificial sequence
  Synthetic oligonucleotide
gcatagtctgtgtctgctcc

SEQ ID NO: 2404 - DNA, 20 bp, Artificial sequence
  Synthetic oligonucleotide
gtgattttcccaattctgga

SEQ ID NO: 2405 - DNA, 20 bp, Artificial sequence
  Synthetic oligonucleotide
tctcttgttaaatcatggca

SEQ ID NO: 2406 - DNA, 20 bp, Artificial sequence
  Synthetic oligonucleotide
ccttggctccaattttccaa

SEQ ID NO: 2407 - DNA, 20 bp, Artificial sequence
  Synthetic oligonucleotide
gtccactttcttctttgatt

SEQ ID NO: 2408 - DNA, 20 bp, Artificial sequence
  Synthetic oligonucleotide
gttcaaattctgcctgcctt

SEQ ID NO: 2409 - DNA, 20 bp, Artificial sequence
  Synthetic oligonucleotide
tccctaccttcccagctttc

SEQ ID NO: 2410 - DNA, 20 bp, Artificial sequence
  Synthetic oligonucleotide
gctctacctctgaccaagct

SEQ ID NO: 2411 - DNA, 20 bp, Artificial sequence
  Synthetic oligonucleotide
ctcaaactcattcctaagca

SEQ ID NO: 2412 - DNA, 20 bp, Artificial sequence
  Synthetic oligonucleotide
agctgcctttacattcaaac

SEQ ID NO: 2413 - DNA, 20 bp, Artificial sequence
  Synthetic oligonucleotide
tctatattttggtcccaacc

SEQ ID NO: 2414 - DNA, 20 bp, Artificial sequence
  Synthetic oligonucleotide
cctcattagatttcctccaa

SEQ ID NO: 2415 - DNA, 20 bp, Artificial sequence
  Synthetic oligonucleotide
cttgggcatcatttttgctc

SEQ ID NO: 2416 - DNA, 20 bp, Artificial sequence
  Synthetic oligonucleotide
atcagtttttctctaggtat

SEQ ID NO: 2417 - DNA, 20 bp, Artificial sequence
  Synthetic oligonucleotide
actcttcagttatatcctca

SEQ ID NO: 2418 - DNA, 20 bp, Artificial sequence
  Synthetic oligonucleotide
cggctgcttttcacttccac

SEQ ID NO: 2419 - DNA, 20 bp, Artificial sequence
  Synthetic oligonucleotide
tgcatagtctgtgtctgctc

SEQ ID NO: 2420 - DNA, 20 bp, Artificial sequence
  Synthetic oligonucleotide
cggacatacttctttagcat

SEQ ID NO: 2421 - DNA, 20 bp, Artificial sequence
  Synthetic oligonucleotide
gcttttccataccagtccct

SEQ ID NO: 2422 - DNA, 20 bp, Artificial sequence
  Synthetic oligonucleotide
ccagattgtcttaaagctcc

SEQ ID NO: 2423 - DNA, 20 bp, Artificial sequence
  Synthetic oligonucleotide
gccttttccatccaaggact

SEQ ID NO: 2424 - DNA, 20 bp, Artificial sequence
  Synthetic oligonucleotide
gccttttcatacccatctgc

SEQ ID NO: 2425 - DNA, 20 bp, Artificial sequence
  Synthetic oligonucleotide
ggaaccatcttaatcactcc

SEQ ID NO: 2426 - DNA, 20 bp, Artificial sequence
  Synthetic oligonucleotide
ccaacatccacactcagaac

SEQ ID NO: 2427 - DNA, 20 bp, Artificial sequence
  Synthetic oligonucleotide
tcctcacactgctcatccac

SEQ ID NO: 2428 - DNA, 20 bp, Artificial sequence
  Synthetic oligonucleotide
gtccttggctccaattttcc

SEQ ID NO: 2429 - DNA, 20 bp, Artificial sequence
  Synthetic oligonucleotide
tgccacttccattttcatct

SEQ ID NO: 2430 - DNA, 20 bp, Artificial sequence
  Synthetic oligonucleotide
cctgctctacctctgaccaa

SEQ ID NO: 2431 - DNA, 20 bp, Artificial sequence
  Synthetic oligonucleotide
catcagttacacctatgtcc

SEQ ID NO: 2432 - DNA, 20 bp, Artificial sequence
  Synthetic oligonucleotide
tgcttcttgactttacagct

SEQ ID NO: 2433 - DNA, 20 bp, Artificial sequence
  Synthetic oligonucleotide
gatgtctttttgacatgtct

SEQ ID NO: 2434 - DNA, 20 bp, Artificial sequence
  Synthetic oligonucleotide
agactgtcactctcacgccc

SEQ ID NO: 2435 - DNA, 20 bp, Artificial sequence
  Synthetic oligonucleotide
tttcacttagcttaaggcca

SEQ ID NO: 2436 - DNA, 20 bp, Artificial sequence
  Synthetic oligonucleotide
tctggtacatacattccaca

SEQ ID NO: 2437 - DNA, 20 bp, Artificial sequence
  Synthetic oligonucleotide
accaggtgaaatcttctttc

SEQ ID NO: 2438 - DNA, 20 bp, Artificial sequence
  Synthetic oligonucleotide
ctgtttcaataacaccagca

SEQ ID NO: 2439 - DNA, 20 bp, Artificial sequence
  Synthetic oligonucleotide
ttgcttgtatttataagcac

SEQ ID NO: 2440 - DNA, 20 bp, Artificial sequence
  Synthetic oligonucleotide
gcctttccttatttttgcta

SEQ ID NO: 2441 - DNA, 20 bp, Artificial sequence
  Synthetic oligonucleotide
gcccatgatgacctttccct

SEQ ID NO: 2442 - DNA, 20 bp, Artificial sequence
  Synthetic oligonucleotide
gtggtgacatttcatgagcc

SEQ ID NO: 2443 - DNA, 20 bp, Artificial sequence
  Synthetic oligonucleotide
atgactcaaccatttggcta

SEQ ID NO: 2444 - DNA, 20 bp, Artificial sequence
  Synthetic oligonucleotide
gtaagctgcctttacattca

SEQ ID NO: 2445 - DNA, 20 bp, Artificial sequence
  Synthetic oligonucleotide
cctttagttcttttagttca

SEQ ID NO: 2446 - DNA, 20 bp, Artificial sequence
  Synthetic oligonucleotide
gccatccctcttctgcccat

SEQ ID NO: 2447 - DNA, 20 bp, Artificial sequence
  Synthetic oligonucleotide
tatcagtttttctctaggta

SEQ ID NO: 2448 - DNA, 20 bp, Artificial sequence
  Synthetic oligonucleotide
ctggtcctgcattcagcccc

SEQ ID NO: 2449 - DNA, 20 bp, Artificial sequence
  Synthetic oligonucleotide
gtgcatcctctccatcttca

SEQ ID NO: 2450 - DNA, 20 bp, Artificial sequence
  Synthetic oligonucleotide
agactttcaaattctagcca

SEQ ID NO: 2451 - DNA, 20 bp, Artificial sequence
  Synthetic oligonucleotide
ttgctagcaaagattctact

SEQ ID NO: 2452 - DNA, 20 bp, Artificial sequence
  Synthetic oligonucleotide
gtgcaactctgaactaggta

SEQ ID NO: 2453 - DNA, 20 bp, Artificial sequence
  Synthetic oligonucleotide
tgctactgacataatacaca

SEQ ID NO: 2454 - DNA, 20 bp, Artificial sequence
  Synthetic oligonucleotide
gcaacatatactgctatatt

SEQ ID NO: 2455 - DNA, 20 bp, Artificial sequence
  Synthetic oligonucleotide
gtacaaactctctaccaggc

SEQ ID NO: 2456 - DNA, 20 bp, Artificial sequence
  Synthetic oligonucleotide
agcttattacttgacagttc

SEQ ID NO: 2457 - DNA, 20 bp, Artificial sequence
  Synthetic oligonucleotide
ccatcacagaacattcttgt

SEQ ID NO: 2458 - DNA, 20 bp, Artificial sequence
  Synthetic oligonucleotide
cctactctttagcactggcc

SEQ ID NO: 2459 - DNA, 20 bp, Artificial sequence
  Synthetic oligonucleotide
gctgttccaatgattttcct

SEQ ID NO: 2460 - DNA, 20 bp, Artificial sequence
  Synthetic oligonucleotide
ccttccttctatgtacagtc

SEQ ID NO: 2461 - DNA, 20 bp, Artificial sequence
  Synthetic oligonucleotide
ccacacagccctcactcgat

SEQ ID NO: 2462 - DNA, 20 bp, Artificial sequence
  Synthetic oligonucleotide
ccatgatcttactcttgcaa

SEQ ID NO: 2463 - DNA, 20 bp, Artificial sequence
  Synthetic oligonucleotide
gggctattctttcttttccc

SEQ ID NO: 2464 - DNA, 20 bp, Artificial sequence
  Synthetic oligonucleotide
ttccggattatttcacattc

SEQ ID NO: 2465 - DNA, 20 bp, Artificial sequence
  Synthetic oligonucleotide
tcttgttacatacttcccat

SEQ ID NO: 2466 - DNA, 20 bp, Artificial sequence
  Synthetic oligonucleotide
cagcacatttagccttatta

SEQ ID NO: 2467 - DNA, 20 bp, Artificial sequence
  Synthetic oligonucleotide
tgctaaatcagttctcttgc

SEQ ID NO: 2468 - DNA, 20 bp, Artificial sequence
  Synthetic oligonucleotide
acgccatttgaacttgggca

SEQ ID NO: 2469 - DNA, 20 bp, Artificial sequence
  Synthetic oligonucleotide
tttgcctcattttctatgca

SEQ ID NO: 2470 - DNA, 20 bp, Artificial sequence
  Synthetic oligonucleotide
cagcaataccaacatcacat

SEQ ID NO: 2471 - DNA, 20 bp, Artificial sequence
  Synthetic oligonucleotide
aatgttggtctatatatttc

SEQ ID NO: 2472 - DNA, 20 bp, Artificial sequence
  Synthetic oligonucleotide
acttcatccctactttggtc

SEQ ID NO: 2473 - DNA, 20 bp, Artificial sequence
  Synthetic oligonucleotide
gcctctgaaaacatctggca

SEQ ID NO: 2474 - DNA, 20 bp, Artificial sequence
  Synthetic oligonucleotide
tcctagagcaatcattgtac

SEQ ID NO: 2475 - DNA, 20 bp, Artificial sequence
  Synthetic oligonucleotide
cgtattcctatctttctgta

SEQ ID NO: 2476 - DNA, 20 bp, Artificial sequence
  Synthetic oligonucleotide
gagcttcttttctcctacat

SEQ ID NO: 2477 - DNA, 20 bp, Artificial sequence
  Synthetic oligonucleotide
ccatagagctctcaatccca

SEQ ID NO: 2478 - DNA, 20 bp, Artificial sequence
  Synthetic oligonucleotide
aggctactcttcaacttagt

SEQ ID NO: 2479 - DNA, 20 bp, Artificial sequence
  Synthetic oligonucleotide
gcgggcatttttcactctaa

SEQ ID NO: 2480 - DNA, 20 bp, Artificial sequence
  Synthetic oligonucleotide
agatatttcaatatacagtg

SEQ ID NO: 2481 - DNA, 20 bp, Artificial sequence
  Synthetic oligonucleotide
ctatccctaccttcccagct

SEQ ID NO: 2482 - DNA, 20 bp, Artificial sequence
  Synthetic oligonucleotide
tctctatattttggtcccaa

SEQ ID NO: 2483 - DNA, 20 bp, Artificial sequence
  Synthetic oligonucleotide
tggtgccacctctagtggtc

SEQ ID NO: 2484 - DNA, 20 bp, Artificial sequence
  Synthetic oligonucleotide
gcattgtcccagacacagca

SEQ ID NO: 2485 - DNA, 20 bp, Artificial sequence
  Synthetic oligonucleotide
tcccacacatgcatctccca

SEQ ID NO: 2486 - DNA, 20 bp, Artificial sequence
  Synthetic oligonucleotide
tcaaactctccatactccca

SEQ ID NO: 2487 - DNA, 20 bp, Artificial sequence
  Synthetic oligonucleotide
tactcttcagttatatcctc

SEQ ID NO: 2488 - DNA, 20 bp, Artificial sequence
  Synthetic oligonucleotide
gggtttctttttctcaccta

SEQ ID NO: 2489 - DNA, 20 bp, Artificial sequence
  Synthetic oligonucleotide
actcatccctgattgcctca

SEQ ID NO: 2490 - DNA, 20 bp, Artificial sequence
  Synthetic oligonucleotide
ttgtttgccttcaatgctgc

SEQ ID NO: 2491 - DNA, 20 bp, Artificial sequence
  Synthetic oligonucleotide
gtgcatcatattctacacta

SEQ ID NO: 2492 - DNA, 20 bp, Artificial sequence
  Synthetic oligonucleotide
gtagcagtctccactggtga

SEQ ID NO: 2493 - DNA, 20 bp, Artificial sequence
  Synthetic oligonucleotide
ggaggctctttctctacttc

SEQ ID NO: 2494 - DNA, 20 bp, Artificial sequence
  Synthetic oligonucleotide
gttcaccttcacacatcctt

SEQ ID NO: 2495 - DNA, 20 bp, Artificial sequence
  Synthetic oligonucleotide
ctcctgtctttacaacgacc

SEQ ID NO: 2496 - DNA, 20 bp, Artificial sequence
  Synthetic oligonucleotide
acattattctataaatggac

SEQ ID NO: 2497 - DNA, 20 bp, Artificial sequence
  Synthetic oligonucleotide
tccatcttcacttcagagat

SEQ ID NO: 2498 - DNA, 20 bp, Artificial sequence
  Synthetic oligonucleotide
cttctgcaaagaacaccaat

SEQ ID NO: 2499 - DNA, 20 bp, Artificial sequence
  Synthetic oligonucleotide
gcaaagaacaccaatttttg

SEQ ID NO: 2500 - DNA, 20 bp, Artificial sequence
  Synthetic oligonucleotide
catgagtccaatgattgcac

SEQ ID NO: 2501 - DNA, 20 bp, Artificial sequence
  Synthetic oligonucleotide
tatgacaacaccgcccacca

SEQ ID NO: 2502 - DNA, 20 bp, Artificial sequence
  Synthetic oligonucleotide
acaccgcccaccatgagtcc

SEQ ID NO: 2503 - DNA, 20 bp, Artificial sequence
  Synthetic oligonucleotide
gagtaaatcataaaacgggt

SEQ ID NO: 2504 - DNA, 20 bp, Artificial sequence
  Synthetic oligonucleotide
gcatgccttcctcatcccct

SEQ ID NO: 2505 - DNA, 20 bp, Artificial sequence
  Synthetic oligonucleotide
tcttcccacattattctata

SEQ ID NO: 2506 - DNA, 20 bp, Artificial sequence
  Synthetic oligonucleotide
ccatcttcacttcagagatc

SEQ ID NO: 2507 - DNA, 20 bp, Artificial sequence
  Synthetic oligonucleotide
tcagccccaaaagaatgcca

SEQ ID NO: 2508 - DNA, 20 bp, Artificial sequence
  Synthetic oligonucleotide
caaagattccactttctcct

SEQ ID NO: 2509 - DNA, 20 bp, Artificial sequence
  Synthetic oligonucleotide
ccaaagattccactttctcc

SEQ ID NO: 2510 - DNA, 20 bp, Artificial sequence
  Synthetic oligonucleotide
catggcttccactctggcca

SEQ ID NO: 2511 - DNA, 20 bp, Artificial sequence
  Synthetic oligonucleotide
tccaaagattccactttctc

SEQ ID NO: 2512 - DNA, 20 bp, Artificial sequence
  Synthetic oligonucleotide
catgcgctcataaatcacac

SEQ ID NO: 2513 - DNA, 20 bp, Artificial sequence
  Synthetic oligonucleotide
cttttgtatcataaatgaaa

SEQ ID NO: 2514 - DNA, 20 bp, Artificial sequence
  Synthetic oligonucleotide
cagccccaaaagaatgccac

SEQ ID NO: 2515 - DNA, 20 bp, Artificial sequence
  Synthetic oligonucleotide
cttcttatcagctttaggca

SEQ ID NO: 2516 - DNA, 20 bp, Artificial sequence
  Synthetic oligonucleotide
acacacaaactctacccctc

SEQ ID NO: 2517 - DNA, 20 bp, Artificial sequence
  Synthetic oligonucleotide
aaactctacccctcggaact

SEQ ID NO: 2518 - DNA, 20 bp, Artificial sequence
  Synthetic oligonucleotide
tcttcactcccatctgcata

SEQ ID NO: 2519 - DNA, 20 bp, Artificial sequence
  Synthetic oligonucleotide
ctacccctcggaacttgtca

SEQ ID NO: 2520 - DNA, 20 bp, Artificial sequence
  Synthetic oligonucleotide
cacctcagccacttcttcct

SEQ ID NO: 2521 - DNA, 20 bp, Artificial sequence
  Synthetic oligonucleotide
gcagaatccacattgtcact

SEQ ID NO: 2522 - DNA, 20 bp, Artificial sequence
  Synthetic oligonucleotide
cctctgctacttctactact

SEQ ID NO: 2523 - DNA, 20 bp, Artificial sequence
  Synthetic oligonucleotide
cttcccattctctcatgacc

SEQ ID NO: 2524 - DNA, 20 bp, Artificial sequence
  Synthetic oligonucleotide
tcttcttccacctcagccac

SEQ ID NO: 2525 - DNA, 20 bp, Artificial sequence
  Synthetic oligonucleotide
gctcagagccaggcgagtca

SEQ ID NO: 2526 - DNA, 20 bp, Artificial sequence
  Synthetic oligonucleotide
gcatcacttacaaactcacc

SEQ ID NO: 2527 - DNA, 20 bp, Artificial sequence
  Synthetic oligonucleotide
tgtgcacataaaacaggcac

SEQ ID NO: 2528 - DNA, 20 bp, Artificial sequence
  Synthetic oligonucleotide
gatctgaatcccacttccca

SEQ ID NO: 2529 - DNA, 20 bp, Artificial sequence
  Synthetic oligonucleotide
cccacttcccattctggaca

SEQ ID NO: 2530 - DNA, 20 bp, Artificial sequence
  Synthetic oligonucleotide
attctggacattcatgtgca

SEQ ID NO: 2531 - DNA, 20 bp, Artificial sequence
  Synthetic oligonucleotide
catcacttacaaactcacca

SEQ ID NO: 2532 - DNA, 20 bp, Artificial sequence
  Synthetic oligonucleotide
gtttcgcaaacatccatcct

SEQ ID NO: 2533 - DNA, 20 bp, Artificial sequence
  Synthetic oligonucleotide
gtaggaactcgaaccacctc

SEQ ID NO: 2534 - DNA, 20 bp, Artificial sequence
  Synthetic oligonucleotide
aactcgaaccacctcttcca

SEQ ID NO: 2535 - DNA, 20 bp, Artificial sequence
  Synthetic oligonucleotide
actcgaaccacctcttccac

SEQ ID NO: 2536 - DNA, 20 bp, Artificial sequence
  Synthetic oligonucleotide
gaactcgaaccacctcttcc

SEQ ID NO: 2537 - DNA, 20 bp, Artificial sequence
  Synthetic oligonucleotide
taggaactcgaaccacctct

SEQ ID NO: 2538 - DNA, 20 bp, Artificial sequence
  Synthetic oligonucleotide
aggaactcgaaccacctctt

SEQ ID NO: 2539 - DNA, 20 bp, Artificial sequence
  Synthetic oligonucleotide
ggaactcgaaccacctcttc

SEQ ID NO: 2540 - DNA, 20 bp, Artificial sequence
  Synthetic oligonucleotide
ttgtaggaactcgaaccacc

SEQ ID NO: 2541 - DNA, 20 bp, Artificial sequence
  Synthetic oligonucleotide
gttgtaggaactcgaaccac

SEQ ID NO: 2542 - DNA, 20 bp, Artificial sequence
  Synthetic oligonucleotide
gctgttgtaggaactcgaac

SEQ ID NO: 2543 - DNA, 16 bp, Artificial sequence
  Synthetic oligonucleotide
ccttatattgccactt

SEQ ID NO: 2544 - DNA, 16 bp, Artificial sequence
  Synthetic oligonucleotide
ttatattgccacttcc

SEQ ID NO: 2545 - DNA, 16 bp, Artificial sequence
  Synthetic oligonucleotide
agcaatggttttgctg

SEQ ID NO: 2546 - DNA, 16 bp, Artificial sequence
  Synthetic oligonucleotide
tcagagatctcctccg

SEQ ID NO: 2547 - DNA, 16 bp, Artificial sequence
  Synthetic oligonucleotide
cgtaactgatccttgg

SEQ ID NO: 2548 - DNA, 16 bp, Artificial sequence
  Synthetic oligonucleotide
gatacttgtcaacggc

SEQ ID NO: 2549 - DNA, 16 bp, Artificial sequence
  Synthetic oligonucleotide
cttcatatcctgagtc

SEQ ID NO: 2550 - DNA, 16 bp, Artificial sequence
  Synthetic oligonucleotide
gatatttgtcaaccca

SEQ ID NO: 2551 - DNA, 16 bp, Artificial sequence
  Synthetic oligonucleotide
tatattgccacttcca

SEQ ID NO: 2552 - DNA, 16 bp, Artificial sequence
  Synthetic oligonucleotide
atccccttatattgcc

SEQ ID NO: 2553 - DNA, 16 bp, Artificial sequence
  Synthetic oligonucleotide
tgccgtagtcatgcaa

SEQ ID NO: 2554 - DNA, 16 bp, Artificial sequence
  Synthetic oligonucleotide
tcgcaaacatccatcc

SEQ ID NO: 2555 - DNA, 16 bp, Artificial sequence
  Synthetic oligonucleotide
gtacaatcatcctgca

SEQ ID NO: 2556 - DNA, 16 bp, Artificial sequence
  Synthetic oligonucleotide
ctattcatgcactagt

SEQ ID NO: 2557 - DNA, 16 bp, Artificial sequence
  Synthetic oligonucleotide
atacttgtcaacggca

SEQ ID NO: 2558 - DNA, 16 bp, Artificial sequence
  Synthetic oligonucleotide
ccgtagtcatgcaagt

SEQ ID NO: 2559 - DNA, 16 bp, Artificial sequence
  Synthetic oligonucleotide
catcatcggcttcttc

SEQ ID NO: 2560 - DNA, 16 bp, Artificial sequence
  Synthetic oligonucleotide
tacaatcatcctgcag

SEQ ID NO: 2561 - DNA, 16 bp, Artificial sequence
  Synthetic oligonucleotide
gcaaacatccatcctc

SEQ ID NO: 2562 - DNA, 16 bp, Artificial sequence
  Synthetic oligonucleotide
tgtcataagcaatgat

SEQ ID NO: 2563 - DNA, 16 bp, Artificial sequence
  Synthetic oligonucleotide
taattcaagttcaggc

SEQ ID NO: 2564 - DNA, 16 bp, Artificial sequence
  Synthetic oligonucleotide
tgttacagcacagctg

SEQ ID NO: 2565 - DNA, 16 bp, Artificial sequence
  Synthetic oligonucleotide
aattcaagttcaggca

SEQ ID NO: 2566 - DNA, 16 bp, Artificial sequence
  Synthetic oligonucleotide
ctacttgtgttacagc

SEQ ID NO: 2567 - DNA, 16 bp, Artificial sequence
  Synthetic oligonucleotide
  misc_feature (5)..(5): bases at these postions are RNA
ctatucatgcactagt

SEQ ID NO: 2568 - DNA, 16 bp, Artificial sequence
  Synthetic oligonucleotide
  misc_feature (5)..(5): bases at these postions are RNA
ctacutgtgttacagc

SEQ ID NO: 2569 - DNA, 16 bp, Artificial sequence
  Synthetic oligonucleotide
  misc_feature (5)..(5): bases at these postions are RNA
taatucaagttcaggc

SEQ ID NO: 2570 - DNA, 16 bp, Artificial sequence
  Synthetic oligonucleotide
  misc_feature (5)..(5): bases at these postions are RNA
atacutgtcaacggca

SEQ ID NO: 2571 - DNA, 16 bp, Artificial sequence
  Synthetic oligonucleotide
  misc_feature (5)..(5): bases at these postions are RNA
tatautgccacttcca

SEQ ID NO: 2572 - DNA, 16 bp, Artificial sequence
  Synthetic oligonucleotide
  misc_feature (5)..(5): bases at these postions are RNA
gatauttgtcaaccca

SEQ ID NO: 2573 - DNA, 20 bp, Artificial sequence
  Synthetic oligonucleotide
ctgggacactgcacctccct

SEQ ID NO: 2574 - DNA, 20 bp, Artificial sequence
  Synthetic oligonucleotide
tctgaattttagtatgctat

SEQ ID NO: 2575 - DNA, 20 bp, Artificial sequence
  Synthetic oligonucleotide
tctctgttctcaattcatgg

SEQ ID NO: 2576 - DNA, 20 bp, Artificial sequence
  Synthetic oligonucleotide
tgtactatttttccaagttc

SEQ ID NO: 2577 - DNA, 20 bp, Artificial sequence
  Synthetic oligonucleotide
tcagtttcctggttttgata

SEQ ID NO: 2578 - DNA, 20 bp, Artificial sequence
  Synthetic oligonucleotide
ggttctttttctttcttttt

SEQ ID NO: 2579 - DNA, 20 bp, Artificial sequence
  Synthetic oligonucleotide
gtattgttttaaatgttcct

SEQ ID NO: 2580 - DNA, 20 bp, Artificial sequence
  Synthetic oligonucleotide
gatacatattgcttatatgt

SEQ ID NO: 2581 - DNA, 20 bp, Artificial sequence
  Synthetic oligonucleotide
gtatctgtttgccaatggta

SEQ ID NO: 2582 - DNA, 20 bp, Artificial sequence
  Synthetic oligonucleotide
catatttcaaaattaatctc

SEQ ID NO: 2583 - DNA, 20 bp, Artificial sequence
  Synthetic oligonucleotide
tggagaacttctttacactt

SEQ ID NO: 2584 - DNA, 20 bp, Artificial sequence
  Synthetic oligonucleotide
ctgtatctatttccaaccca

SEQ ID NO: 2585 - DNA, 20 bp, Artificial sequence
  Synthetic oligonucleotide
atggcttccctgctcagcca

SEQ ID NO: 2586 - DNA, 20 bp, Artificial sequence
  Synthetic oligonucleotide
gtcattggttttaatcagtt

SEQ ID NO: 2587 - DNA, 20 bp, Artificial sequence
  Synthetic oligonucleotide
attgcttgtatttataagca

SEQ ID NO: 2588 - DNA, 20 bp, Artificial sequence
  Synthetic oligonucleotide
tcttgttctcctatttctgt

SEQ ID NO: 2589 - DNA, 20 bp, Artificial sequence
  Synthetic oligonucleotide
ctcagcatgactccattctt

SEQ ID NO: 2590 - DNA, 20 bp, Artificial sequence
  Synthetic oligonucleotide
tcatgtggtattttattctc

SEQ ID NO: 2591 - DNA, 20 bp, Artificial sequence
  Synthetic oligonucleotide
tcactgatttttttcccctc

SEQ ID NO: 2592 - DNA, 20 bp, Artificial sequence
  Synthetic oligonucleotide
ggcttatttccctatagtta

SEQ ID NO: 2593 - DNA, 20 bp, Artificial sequence
  Synthetic oligonucleotide
acctctctgtactatttttc

SEQ ID NO: 2594 - DNA, 20 bp, Artificial sequence
  Synthetic oligonucleotide
gcgacattcctccagtctta

SEQ ID NO: 2595 - DNA, 20 bp, Artificial sequence
  Synthetic oligonucleotide
cctagtctactttggaccca

SEQ ID NO: 2596 - DNA, 20 bp, Artificial sequence
  Synthetic oligonucleotide
ctttatttcctactgccttt

SEQ ID NO: 2597 - DNA, 20 bp, Artificial sequence
  Synthetic oligonucleotide
ccattatttaattaaaccat

SEQ ID NO: 2598 - DNA, 20 bp, Artificial sequence
  Synthetic oligonucleotide
cccctaatatgttcttaatc

SEQ ID NO: 2599 - DNA, 20 bp, Artificial sequence
  Synthetic oligonucleotide
ccacctccactatcttcata

SEQ ID NO: 2600 - DNA, 20 bp, Artificial sequence
  Synthetic oligonucleotide
ccgcatctggtttataataa

SEQ ID NO: 2601 - DNA, 20 bp, Artificial sequence
  Synthetic oligonucleotide
ttgtgctgccctattcttgg

SEQ ID NO: 2602 - DNA, 20 bp, Artificial sequence
  Synthetic oligonucleotide
atcactttactatctgggct

SEQ ID NO: 2603 - DNA, 20 bp, Artificial sequence
  Synthetic oligonucleotide
tgctctgattccagatgata

SEQ ID NO: 2604 - DNA, 20 bp, Artificial sequence
  Synthetic oligonucleotide
tactgatgtctattctccaa

SEQ ID NO: 2605 - DNA, 20 bp, Artificial sequence
  Synthetic oligonucleotide
gactccattcttcctcattt

SEQ ID NO: 2606 - DNA, 20 bp, Artificial sequence
  Synthetic oligonucleotide
accatgttttctagaagatt

SEQ ID NO: 2607 - DNA, 20 bp, Artificial sequence
  Synthetic oligonucleotide
ctgcagcctcagccacccca

SEQ ID NO: 2608 - DNA, 20 bp, Artificial sequence
  Synthetic oligonucleotide
tttaatgtcaattttcccct

SEQ ID NO: 2609 - DNA, 20 bp, Artificial sequence
  Synthetic oligonucleotide
gccaacattacctactgcaa

SEQ ID NO: 2610 - DNA, 20 bp, Artificial sequence
  Synthetic oligonucleotide
gcataatttactgaagcaga

SEQ ID NO: 2611 - DNA, 20 bp, Artificial sequence
  Synthetic oligonucleotide
ttccactttcatgttccctt

SEQ ID NO: 2612 - DNA, 20 bp, Artificial sequence
  Synthetic oligonucleotide
atgcctcaggctccatccat

SEQ ID NO: 2613 - DNA, 20 bp, Artificial sequence
  Synthetic oligonucleotide
ccttcctttttaatcagaat

SEQ ID NO: 2614 - DNA, 20 bp, Artificial sequence
  Synthetic oligonucleotide
gctcagatagtgtacagggt

SEQ ID NO: 2615 - DNA, 20 bp, Artificial sequence
  Synthetic oligonucleotide
gctctcctgttactgttaat

SEQ ID NO: 2616 - DNA, 20 bp, Artificial sequence
  Synthetic oligonucleotide
gctttgttatcttggccaac

SEQ ID NO: 2617 - DNA, 20 bp, Artificial sequence
  Synthetic oligonucleotide
gctcaacactgagttgctcc

SEQ ID NO: 2618 - DNA, 20 bp, Artificial sequence
  Synthetic oligonucleotide
actcttatgtctgatccctt

SEQ ID NO: 2619 - DNA, 20 bp, Artificial sequence
  Synthetic oligonucleotide
ctgcaagttatgtagctcaa

SEQ ID NO: 2620 - DNA, 20 bp, Artificial sequence
  Synthetic oligonucleotide
acacatctgctctagtgttc

SEQ ID NO: 2621 - DNA, 20 bp, Artificial sequence
  Synthetic oligonucleotide
cctgtgtccttatttcttca

SEQ ID NO: 2622 - DNA, 20 bp, Artificial sequence
  Synthetic oligonucleotide
agttcattcccctagcctgc

SEQ ID NO: 2623 - DNA, 20 bp, Artificial sequence
  Synthetic oligonucleotide
atccaatgcatcaattcctt

SEQ ID NO: 2624 - DNA, 20 bp, Artificial sequence
  Synthetic oligonucleotide
gcactgattcctctttttct

SEQ ID NO: 2625 - DNA, 20 bp, Artificial sequence
  Synthetic oligonucleotide
ccgatagcattccttcttct

SEQ ID NO: 2626 - DNA, 20 bp, Artificial sequence
  Synthetic oligonucleotide
ttccttcttctcagcatgac

SEQ ID NO: 2627 - DNA, 20 bp, Artificial sequence
  Synthetic oligonucleotide
ggcaggtcttggcttccacc

SEQ ID NO: 2628 - DNA, 20 bp, Artificial sequence
  Synthetic oligonucleotide
tcaccttttaatctacaact

SEQ ID NO: 2629 - DNA, 20 bp, Artificial sequence
  Synthetic oligonucleotide
ccttatttcttcaatctcct

SEQ ID NO: 2630 - DNA, 20 bp, Artificial sequence
  Synthetic oligonucleotide
attcttcctcattttcaccc

SEQ ID NO: 2631 - DNA, 20 bp, Artificial sequence
  Synthetic oligonucleotide
tgttctttatttttattata

SEQ ID NO: 2632 - DNA, 20 bp, Artificial sequence
  Synthetic oligonucleotide
ctgtcttaatagtataccgt

SEQ ID NO: 2633 - DNA, 20 bp, Artificial sequence
  Synthetic oligonucleotide
actccacagtccctcatcct

SEQ ID NO: 2634 - DNA, 20 bp, Artificial sequence
  Synthetic oligonucleotide
atcatcacttgacacatgcc

SEQ ID NO: 2635 - DNA, 20 bp, Artificial sequence
  Synthetic oligonucleotide
ttgcatgtcatccttgtgca

SEQ ID NO: 2636 - DNA, 20 bp, Artificial sequence
  Synthetic oligonucleotide
agcagctttttttttttctt

SEQ ID NO: 2637 - DNA, 20 bp, Artificial sequence
  Synthetic oligonucleotide
tacaacttttgtttttctca

SEQ ID NO: 2638 - DNA, 20 bp, Artificial sequence
  Synthetic oligonucleotide
aagttgctttttttctcttc

SEQ ID NO: 2639 - DNA, 20 bp, Artificial sequence
  Synthetic oligonucleotide
agtctttagtcttattcatc

SEQ ID NO: 2640 - DNA, 20 bp, Artificial sequence
  Synthetic oligonucleotide
aatgccagctcttttctccg

SEQ ID NO: 2641 - DNA, 20 bp, Artificial sequence
  Synthetic oligonucleotide
gtttgactgcattaagcaca

SEQ ID NO: 2642 - DNA, 20 bp, Artificial sequence
  Synthetic oligonucleotide
ttctccttttgccagtgtct

SEQ ID NO: 2643 - DNA, 20 bp, Artificial sequence
  Synthetic oligonucleotide
ccccttcaccgatagcattc

SEQ ID NO: 2644 - DNA, 20 bp, Artificial sequence
  Synthetic oligonucleotide
acatatttcaaaattaatct

SEQ ID NO: 2645 - DNA, 20 bp, Artificial sequence
  Synthetic oligonucleotide
ttccctctttatttcctact

SEQ ID NO: 2646 - DNA, 20 bp, Artificial sequence
  Synthetic oligonucleotide
tagttattacctatgccact

SEQ ID NO: 2647 - DNA, 20 bp, Artificial sequence
  Synthetic oligonucleotide
gtgcttttccaacaagttcc

SEQ ID NO: 2648 - DNA, 20 bp, Artificial sequence
  Synthetic oligonucleotide
gcctaaatacatttctttgc

SEQ ID NO: 2649 - DNA, 20 bp, Artificial sequence
  Synthetic oligonucleotide
gctttttttctcttcttttt

SEQ ID NO: 2650 - DNA, 20 bp, Artificial sequence
  Synthetic oligonucleotide
tctccgttctctatgcaaat

SEQ ID NO: 2651 - DNA, 20 bp, Artificial sequence
  Synthetic oligonucleotide
ctccttcctttttaatcaga

SEQ ID NO: 2652 - DNA, 20 bp, Artificial sequence
  Synthetic oligonucleotide
gccagatacatattgcttat

SEQ ID NO: 2653 - DNA, 20 bp, Artificial sequence
  Synthetic oligonucleotide
cttcataaattcttgctcaa

SEQ ID NO: 2654 - DNA, 20 bp, Artificial sequence
  Synthetic oligonucleotide
ttggagaacttctttacact

SEQ ID NO: 2655 - DNA, 20 bp, Artificial sequence
  Synthetic oligonucleotide
attccttcttctcagcatga

SEQ ID NO: 2656 - DNA, 20 bp, Artificial sequence
  Synthetic oligonucleotide
cctgtatctatttccaaccc

SEQ ID NO: 2657 - DNA, 20 bp, Artificial sequence
  Synthetic oligonucleotide
cagtctttagtcttattcat

SEQ ID NO: 2658 - DNA, 20 bp, Artificial sequence
  Synthetic oligonucleotide
cctcatcctctcagcccctg

SEQ ID NO: 2659 - DNA, 20 bp, Artificial sequence
  Synthetic oligonucleotide
agttatctaaatatcctccc

SEQ ID NO: 2660 - DNA, 20 bp, Artificial sequence
  Synthetic oligonucleotide
gacctctctgtactattttt

SEQ ID NO: 2661 - DNA, 20 bp, Artificial sequence
  Synthetic oligonucleotide
ctcattttagtcattggttt

SEQ ID NO: 2662 - DNA, 20 bp, Artificial sequence
  Synthetic oligonucleotide
tccccttcaccgatagcatt

SEQ ID NO: 2663 - DNA, 20 bp, Artificial sequence
  Synthetic oligonucleotide
tcacacatttgtatcttgct

SEQ ID NO: 2664 - DNA, 20 bp, Artificial sequence
  Synthetic oligonucleotide
tgactccattcttcctcatt

SEQ ID NO: 2665 - DNA, 20 bp, Artificial sequence
  Synthetic oligonucleotide
ttactgatgtctattctcca

SEQ ID NO: 2666 - DNA, 20 bp, Artificial sequence
  Synthetic oligonucleotide
ctctgaattttagtatgcta

SEQ ID NO: 2667 - DNA, 20 bp, Artificial sequence
  Synthetic oligonucleotide
tcttcctttttttgagacag

SEQ ID NO: 2668 - DNA, 20 bp, Artificial sequence
  Synthetic oligonucleotide
gcccttgttccagtctaaaa

SEQ ID NO: 2669 - DNA, 20 bp, Artificial sequence
  Synthetic oligonucleotide
acctagtctactttggaccc

SEQ ID NO: 2670 - DNA, 20 bp, Artificial sequence
  Synthetic oligonucleotide
cccactttcatcactttact

SEQ ID NO: 2671 - DNA, 20 bp, Artificial sequence
  Synthetic oligonucleotide
tctgcaagttatgtagctca

SEQ ID NO: 2672 - DNA, 20 bp, Artificial sequence
  Synthetic oligonucleotide
gcattttttttctatgaatt

SEQ ID NO: 2673 - DNA, 20 bp, Artificial sequence
  Synthetic oligonucleotide
accccctaatatgttcttaa

SEQ ID NO: 2674 - DNA, 20 bp, Artificial sequence
  Synthetic oligonucleotide
tggttctttttctttctttt

SEQ ID NO: 2675 - DNA, 20 bp, Artificial sequence
  Synthetic oligonucleotide
acagatgtttgactgcatta

SEQ ID NO: 2676 - DNA, 20 bp, Artificial sequence
  Synthetic oligonucleotide
gaagttgctttttttctctt

SEQ ID NO: 2677 - DNA, 20 bp, Artificial sequence
  Synthetic oligonucleotide
acatcatcacttgacacatg

SEQ ID NO: 2678 - DNA, 20 bp, Artificial sequence
  Synthetic oligonucleotide
ctgcactgattcctcttttt

SEQ ID NO: 2679 - DNA, 20 bp, Artificial sequence
  Synthetic oligonucleotide
tcctgtgtccttatttcttc

SEQ ID NO: 2680 - DNA, 20 bp, Artificial sequence
  Synthetic oligonucleotide
atacaacttttgtttttctc

SEQ ID NO: 2681 - DNA, 20 bp, Artificial sequence
  Synthetic oligonucleotide
gcatcataatttgagagcca

SEQ ID NO: 2682 - DNA, 20 bp, Artificial sequence
  Synthetic oligonucleotide
atgctttgttatcttggcca

SEQ ID NO: 2683 - DNA, 20 bp, Artificial sequence
  Synthetic oligonucleotide
gttagcatttccagccaaca

SEQ ID NO: 2684 - DNA, 20 bp, Artificial sequence
  Synthetic oligonucleotide
ctccacctccactatcttca

SEQ ID NO: 2685 - DNA, 20 bp, Artificial sequence
  Synthetic oligonucleotide
ttctcagcatgactccattc

SEQ ID NO: 2686 - DNA, 20 bp, Artificial sequence
  Synthetic oligonucleotide
gttgatatttaattcctcaa

SEQ ID NO: 2687 - DNA, 20 bp, Artificial sequence
  Synthetic oligonucleotide
tccttatttcttcaatctcc

SEQ ID NO: 2688 - DNA, 20 bp, Artificial sequence
  Synthetic oligonucleotide
actggcagttccccagactg

SEQ ID NO: 2689 - DNA, 20 bp, Artificial sequence
  Synthetic oligonucleotide
tttctccttttgccagtgtc

SEQ ID NO: 2690 - DNA, 20 bp, Artificial sequence
  Synthetic oligonucleotide
gtattttattctctttccaa

SEQ ID NO: 2691 - DNA, 20 bp, Artificial sequence
  Synthetic oligonucleotide
ttggcagctgacagagactc

SEQ ID NO: 2692 - DNA, 20 bp, Artificial sequence
  Synthetic oligonucleotide
gctcagccccatccctagct

SEQ ID NO: 2693 - DNA, 20 bp, Artificial sequence
  Synthetic oligonucleotide
gtcacatgtgaaaacaggct

SEQ ID NO: 2694 - DNA, 20 bp, Artificial sequence
  Synthetic oligonucleotide
aacatatttcaaaattaatc

SEQ ID NO: 2695 - DNA, 20 bp, Artificial sequence
  Synthetic oligonucleotide
acatctctatatggcggtcc

SEQ ID NO: 2696 - DNA, 20 bp, Artificial sequence
  Synthetic oligonucleotide
acccagtgctttcacattga

SEQ ID NO: 2697 - DNA, 20 bp, Artificial sequence
  Synthetic oligonucleotide
ttcaccttttaatctacaac

SEQ ID NO: 2698 - DNA, 20 bp, Artificial sequence
  Synthetic oligonucleotide
tcacaaatttaatgtcaatt

SEQ ID NO: 2699 - DNA, 20 bp, Artificial sequence
  Synthetic oligonucleotide
tggcttatttccctatagtt

SEQ ID NO: 2700 - DNA, 20 bp, Artificial sequence
  Synthetic oligonucleotide
tctctaactttttgagctca

SEQ ID NO: 2701 - DNA, 20 bp, Artificial sequence
  Synthetic oligonucleotide
gtttcttattttttcagttt

SEQ ID NO: 2702 - DNA, 20 bp, Artificial sequence
  Synthetic oligonucleotide
tctttatttcctactgcctt

SEQ ID NO: 2703 - DNA, 20 bp, Artificial sequence
  Synthetic oligonucleotide
cctatagttattacctatgc

SEQ ID NO: 2704 - DNA, 20 bp, Artificial sequence
  Synthetic oligonucleotide
cccacttaatttttcatcct

SEQ ID NO: 2705 - DNA, 20 bp, Artificial sequence
  Synthetic oligonucleotide
atcactgatttttttcccct

SEQ ID NO: 2706 - DNA, 20 bp, Artificial sequence
  Synthetic oligonucleotide
tcctaattgcttgtatttat

SEQ ID NO: 2707 - DNA, 20 bp, Artificial sequence
  Synthetic oligonucleotide
gcatctggtatatttagaat

SEQ ID NO: 2708 - DNA, 20 bp, Artificial sequence
  Synthetic oligonucleotide
ctgtactatttttccaagtt

SEQ ID NO: 2709 - DNA, 20 bp, Artificial sequence
  Synthetic oligonucleotide
actagcagctcagatagtgt

SEQ ID NO: 2710 - DNA, 20 bp, Artificial sequence
  Synthetic oligonucleotide
cctcattttcacccataaaa

SEQ ID NO: 2711 - DNA, 20 bp, Artificial sequence
  Synthetic oligonucleotide
ctttatttttcttgttctcc

SEQ ID NO: 2712 - DNA, 20 bp, Artificial sequence
  Synthetic oligonucleotide
gccactaacatgccatctgc

SEQ ID NO: 2713 - DNA, 20 bp, Artificial sequence
  Synthetic oligonucleotide
gtcatcaactttttagtcct

SEQ ID NO: 2714 - DNA, 20 bp, Artificial sequence
  Synthetic oligonucleotide
tctattctccaagtatacct

SEQ ID NO: 2715 - DNA, 20 bp, Artificial sequence
  Synthetic oligonucleotide
gttccctctttatttcctac

SEQ ID NO: 2716 - DNA, 20 bp, Artificial sequence
  Synthetic oligonucleotide
cattcttcctcattttcacc

SEQ ID NO: 2717 - DNA, 20 bp, Artificial sequence
  Synthetic oligonucleotide
attccactttcatgttccct

SEQ ID NO: 2718 - DNA, 20 bp, Artificial sequence
  Synthetic oligonucleotide
gaaacatatttcaaaattaa

SEQ ID NO: 2719 - DNA, 20 bp, Artificial sequence
  Synthetic oligonucleotide
ctgggtgctctgattccaga

SEQ ID NO: 2720 - DNA, 20 bp, Artificial sequence
  Synthetic oligonucleotide
gccaaattgaacctctgtgc

SEQ ID NO: 2721 - DNA, 20 bp, Artificial sequence
  Synthetic oligonucleotide
catgcctcaggctccatcca

SEQ ID NO: 2722 - DNA, 20 bp, Artificial sequence
  Synthetic oligonucleotide
cactcatggcttccctgctc

SEQ ID NO: 2723 - DNA, 20 bp, Artificial sequence
  Synthetic oligonucleotide
accgatagcattccttcttc

SEQ ID NO: 2724 - DNA, 20 bp, Artificial sequence
  Synthetic oligonucleotide
tttcaactatattcctacta

SEQ ID NO: 2725 - DNA, 20 bp, Artificial sequence
  Synthetic oligonucleotide
gccagagatctttcccgcat

SEQ ID NO: 2726 - DNA, 20 bp, Artificial sequence
  Synthetic oligonucleotide
ccacatctctatatggcggt

SEQ ID NO: 2727 - DNA, 20 bp, Artificial sequence
  Synthetic oligonucleotide
ctctttatttcctactgcct

SEQ ID NO: 2728 - DNA, 20 bp, Artificial sequence
  Synthetic oligonucleotide
tgccagatacatattgctta

SEQ ID NO: 2729 - DNA, 20 bp, Artificial sequence
  Synthetic oligonucleotide
cttctcagcatgactccatt

SEQ ID NO: 2730 - DNA, 20 bp, Artificial sequence
  Synthetic oligonucleotide
actcatgtcattcccagtta

SEQ ID NO: 2731 - DNA, 20 bp, Artificial sequence
  Synthetic oligonucleotide
tcctcattttcacccataaa

SEQ ID NO: 2732 - DNA, 20 bp, Artificial sequence
  Synthetic oligonucleotide
gcattccttcttctcagcat

SEQ ID NO: 2733 - DNA, 20 bp, Artificial sequence
  Synthetic oligonucleotide
gtctattctccaagtatacc

SEQ ID NO: 2734 - DNA, 20 bp, Artificial sequence
  Synthetic oligonucleotide
accagcccttgttccagtct

SEQ ID NO: 2735 - DNA, 20 bp, Artificial sequence
  Synthetic oligonucleotide
gtccttatttcttcaatctc

SEQ ID NO: 2736 - DNA, 20 bp, Artificial sequence
  Synthetic oligonucleotide
tccctatagttattacctat

SEQ ID NO: 2737 - DNA, 20 bp, Artificial sequence
  Synthetic oligonucleotide
cccactatcttttaagttta

SEQ ID NO: 2738 - DNA, 20 bp, Artificial sequence
  Synthetic oligonucleotide
gcaccccctaatatgttctt

SEQ ID NO: 2739 - DNA, 20 bp, Artificial sequence
  Synthetic oligonucleotide
accaccatctgttctgtgga

SEQ ID NO: 2740 - DNA, 20 bp, Artificial sequence
  Synthetic oligonucleotide
ctgaactgactccaaatcta

SEQ ID NO: 2741 - DNA, 20 bp, Artificial sequence
  Synthetic oligonucleotide
tctccttcctttttaatcag

SEQ ID NO: 2742 - DNA, 20 bp, Artificial sequence
  Synthetic oligonucleotide
cctctttttctctaaagttt

SEQ ID NO: 2743 - DNA, 20 bp, Artificial sequence
  Synthetic oligonucleotide
caccccactttcatcacttt

SEQ ID NO: 2744 - DNA, 20 bp, Artificial sequence
  Synthetic oligonucleotide
tgcattttttttctatgaat

SEQ ID NO: 2745 - DNA, 20 bp, Artificial sequence
  Synthetic oligonucleotide
agtctttttcttcctttttt

SEQ ID NO: 2746 - DNA, 20 bp, Artificial sequence
  Synthetic oligonucleotide
tttcttctatctaccgcatt

SEQ ID NO: 2747 - DNA, 20 bp, Artificial sequence
  Synthetic oligonucleotide
catcactgatttttttcccc

SEQ ID NO: 2748 - DNA, 20 bp, Artificial sequence
  Synthetic oligonucleotide
ctacaactttttggagaact

SEQ ID NO: 2749 - DNA, 20 bp, Artificial sequence
  Synthetic oligonucleotide
gttgttcaccttttaatcta

SEQ ID NO: 2750 - DNA, 20 bp, Artificial sequence
  Synthetic oligonucleotide
ccatccatcttccccactga

SEQ ID NO: 2751 - DNA, 20 bp, Artificial sequence
  Synthetic oligonucleotide
tttctccgttctctatgcaa

SEQ ID NO: 2752 - DNA, 20 bp, Artificial sequence
  Synthetic oligonucleotide
acatccatctacaacatcct

SEQ ID NO: 2753 - DNA, 20 bp, Artificial sequence
  Synthetic oligonucleotide
atgaagttgctttttttctc

SEQ ID NO: 2754 - DNA, 20 bp, Artificial sequence
  Synthetic oligonucleotide
tctctgaattttagtatgct

SEQ ID NO: 2755 - DNA, 20 bp, Artificial sequence
  Synthetic oligonucleotide
cactatcttcataaattctt

SEQ ID NO: 2756 - DNA, 20 bp, Artificial sequence
  Synthetic oligonucleotide
cctgacatatgaagtttctt

SEQ ID NO: 2757 - DNA, 20 bp, Artificial sequence
  Synthetic oligonucleotide
tgctttttttctcttctttt

SEQ ID NO: 2758 - DNA, 20 bp, Artificial sequence
  Synthetic oligonucleotide
ttcacacatttgtatcttgc

SEQ ID NO: 2759 - DNA, 20 bp, Artificial sequence
  Synthetic oligonucleotide
atggctgtttttttttttct

SEQ ID NO: 2760 - DNA, 20 bp, Artificial sequence
  Synthetic oligonucleotide
tggtattttattctctttcc

SEQ ID NO: 2761 - DNA, 20 bp, Artificial sequence
  Synthetic oligonucleotide
ccctgatttatgctttgtta

SEQ ID NO: 2762 - DNA, 20 bp, Artificial sequence
  Synthetic oligonucleotide
gccagcagcaacaggccact

SEQ ID NO: 2763 - DNA, 20 bp, Artificial sequence
  Synthetic oligonucleotide
tctcattttagtcattggtt

SEQ ID NO: 2764 - DNA, 20 bp, Artificial sequence
  Synthetic oligonucleotide
gatgcatgagacctctctgt

SEQ ID NO: 2765 - DNA, 20 bp, Artificial sequence
  Synthetic oligonucleotide
ctcctatttctgttctctaa

SEQ ID NO: 2766 - DNA, 20 bp, Artificial sequence
  Synthetic oligonucleotide
tttccccttcaccgatagca

SEQ ID NO: 2767 - DNA, 20 bp, Artificial sequence
  Synthetic oligonucleotide
gtcccacttaatttttcatc

SEQ ID NO: 2768 - DNA, 20 bp, Artificial sequence
  Synthetic oligonucleotide
gcctgcactgattcctcttt

SEQ ID NO: 2769 - DNA, 20 bp, Artificial sequence
  Synthetic oligonucleotide
agctttgacactagcagctc

SEQ ID NO: 2770 - DNA, 20 bp, Artificial sequence
  Synthetic oligonucleotide
actttatttttcttgttctc

SEQ ID NO: 2771 - DNA, 20 bp, Artificial sequence
  Synthetic oligonucleotide
ttgaccatttttagcacttt

SEQ ID NO: 2772 - DNA, 20 bp, Artificial sequence
  Synthetic oligonucleotide
acacactaaatctccagtat

SEQ ID NO: 2773 - DNA, 20 bp, Artificial sequence
  Synthetic oligonucleotide
gttcatccttgactaacaat

SEQ ID NO: 2774 - DNA, 20 bp, Artificial sequence
  Synthetic oligonucleotide
atgagtttttttccccatta

SEQ ID NO: 2775 - DNA, 20 bp, Artificial sequence
  Synthetic oligonucleotide
atggcttatttccctatagt

SEQ ID NO: 2776 - DNA, 20 bp, Artificial sequence
  Synthetic oligonucleotide
actccacctccactatcttc

SEQ ID NO: 2777 - DNA, 20 bp, Artificial sequence
  Synthetic oligonucleotide
aaacatatttcaaaattaat

SEQ ID NO: 2778 - DNA, 20 bp, Artificial sequence
  Synthetic oligonucleotide
gcgaatttcttgattccccg

SEQ ID NO: 2779 - DNA, 20 bp, Artificial sequence
  Synthetic oligonucleotide
gcatgcatttttagggactt

SEQ ID NO: 2780 - DNA, 20 bp, Artificial sequence
  Synthetic oligonucleotide
gcagatatacctctcccact

SEQ ID NO: 2781 - DNA, 20 bp, Artificial sequence
  Synthetic oligonucleotide
ttctctttctatagagaaca

SEQ ID NO: 2782 - DNA, 20 bp, Artificial sequence
  Synthetic oligonucleotide
atggttctttttctttcttt

SEQ ID NO: 2783 - DNA, 20 bp, Artificial sequence
  Synthetic oligonucleotide
ccgtccattaatgtgcagta

SEQ ID NO: 2784 - DNA, 20 bp, Artificial sequence
  Synthetic oligonucleotide
acccaagtttcttacaagtt

SEQ ID NO: 2785 - DNA, 20 bp, Artificial sequence
  Synthetic oligonucleotide
gcacatcctaattgcttgta

SEQ ID NO: 2786 - DNA, 20 bp, Artificial sequence
  Synthetic oligonucleotide
cttactgatgtctattctcc

SEQ ID NO: 2787 - DNA, 20 bp, Artificial sequence
  Synthetic oligonucleotide
tgttccctctttatttccta

SEQ ID NO: 2788 - DNA, 20 bp, Artificial sequence
  Synthetic oligonucleotide
atcctgtgtccttatttctt

SEQ ID NO: 2789 - DNA, 20 bp, Artificial sequence
  Synthetic oligonucleotide
caccgatagcattccttctt

SEQ ID NO: 2790 - DNA, 20 bp, Artificial sequence
  Synthetic oligonucleotide
tctgtactatttttccaagt

SEQ ID NO: 2791 - DNA, 20 bp, Artificial sequence
  Synthetic oligonucleotide
ccattcttcctcattttcac

SEQ ID NO: 2792 - DNA, 20 bp, Artificial sequence
  Synthetic oligonucleotide
acctgtatctatttccaacc

SEQ ID NO: 2793 - DNA, 20 bp, Artificial sequence
  Synthetic oligonucleotide
ctcacaaatttaatgtcaat

SEQ ID NO: 2794 - DNA, 20 bp, Artificial sequence
  Synthetic oligonucleotide
agaccatgcctcaggctcca

SEQ ID NO: 2795 - DNA, 20 bp, Artificial sequence
  Synthetic oligonucleotide
gcatctgcctttttatcctg

SEQ ID NO: 2796 - DNA, 20 bp, Artificial sequence
  Synthetic oligonucleotide
tctcacctatttattaactt

SEQ ID NO: 2797 - DNA, 20 bp, Artificial sequence
  Synthetic oligonucleotide
ccctcatcctctcagcccct

SEQ ID NO: 2798 - DNA, 20 bp, Artificial sequence
  Synthetic oligonucleotide
ccacttcaactgaagtcaca

SEQ ID NO: 2799 - DNA, 20 bp, Artificial sequence
  Synthetic oligonucleotide
ctctctacagatgtttgact

SEQ ID NO: 2800 - DNA, 20 bp, Artificial sequence
  Synthetic oligonucleotide
gccatgtttcccattctggt

SEQ ID NO: 2801 - DNA, 20 bp, Artificial sequence
  Synthetic oligonucleotide
gccatacttcagttgaacca

SEQ ID NO: 2802 - DNA, 20 bp, Artificial sequence
  Synthetic oligonucleotide
atgactccattcttcctcat

SEQ ID NO: 2803 - DNA, 20 bp, Artificial sequence
  Synthetic oligonucleotide
ttcaccgatagcattccttc

SEQ ID NO: 2804 - DNA, 20 bp, Artificial sequence
  Synthetic oligonucleotide
ttgctttttttctcttcttt

SEQ ID NO: 2805 - DNA, 20 bp, Artificial sequence
  Synthetic oligonucleotide
cttctctttctatagagaac

SEQ ID NO: 2806 - DNA, 20 bp, Artificial sequence
  Synthetic oligonucleotide
gtgagagtacaattatttca

SEQ ID NO: 2807 - DNA, 20 bp, Artificial sequence
  Synthetic oligonucleotide
catgcattttttttctatga

SEQ ID NO: 2808 - DNA, 20 bp, Artificial sequence
  Synthetic oligonucleotide
gtggtattttattctctttc

SEQ ID NO: 2809 - DNA, 20 bp, Artificial sequence
  Synthetic oligonucleotide
ccttctatgatttactttct

SEQ ID NO: 2810 - DNA, 20 bp, Artificial sequence
  Synthetic oligonucleotide
tcacaagcatgatgaaccct

SEQ ID NO: 2811 - DNA, 20 bp, Artificial sequence
  Synthetic oligonucleotide
ttcctcattttcacccataa

SEQ ID NO: 2812 - DNA, 20 bp, Artificial sequence
  Synthetic oligonucleotide
ttccgtccattaatgtgcag

SEQ ID NO: 2813 - DNA, 20 bp, Artificial sequence
  Synthetic oligonucleotide
gcacatcatttaccctttaa

SEQ ID NO: 2814 - DNA, 20 bp, Artificial sequence
  Synthetic oligonucleotide
tgccacttcaactgaagtca

SEQ ID NO: 2815 - DNA, 20 bp, Artificial sequence
  Synthetic oligonucleotide
gtttttctcattttagtcat

SEQ ID NO: 2816 - DNA, 20 bp, Artificial sequence
  Synthetic oligonucleotide
tgcgatttagtaattcacaa

SEQ ID NO: 2817 - DNA, 20 bp, Artificial sequence
  Synthetic oligonucleotide
atgtctattctccaagtata

SEQ ID NO: 2818 - DNA, 20 bp, Artificial sequence
  Synthetic oligonucleotide
gcttccaccccactttcatc

SEQ ID NO: 2819 - DNA, 20 bp, Artificial sequence
  Synthetic oligonucleotide
agcacatcctaattgcttgt

SEQ ID NO: 2820 - DNA, 20 bp, Artificial sequence
  Synthetic oligonucleotide
aacctgtatctatttccaac

SEQ ID NO: 2821 - DNA, 20 bp, Artificial sequence
  Synthetic oligonucleotide
cttgaccatttttagcactt

SEQ ID NO: 2822 - DNA, 20 bp, Artificial sequence
  Synthetic oligonucleotide
accctgatttatgctttgtt

SEQ ID NO: 2823 - DNA, 20 bp, Artificial sequence
  Synthetic oligonucleotide
tgtaccttctacaacttttt

SEQ ID NO: 2824 - DNA, 20 bp, Artificial sequence
  Synthetic oligonucleotide
cctgcaggtctgtaacctca

SEQ ID NO: 2825 - DNA, 20 bp, Artificial sequence
  Synthetic oligonucleotide
cttgccatgtttcccattct

SEQ ID NO: 2826 - DNA, 20 bp, Artificial sequence
  Synthetic oligonucleotide
gtatgatttaatagccagca

SEQ ID NO: 2827 - DNA, 20 bp, Artificial sequence
  Synthetic oligonucleotide
atggatgcatgagacctctc

SEQ ID NO: 2828 - DNA, 20 bp, Artificial sequence
  Synthetic oligonucleotide
ctgattcctctttttctcta

SEQ ID NO: 2829 - DNA, 20 bp, Artificial sequence
  Synthetic oligonucleotide
catgactccattcttcctca

SEQ ID NO: 2830 - DNA, 20 bp, Artificial sequence
  Synthetic oligonucleotide
tcttctcagcatgactccat

SEQ ID NO: 2831 - DNA, 20 bp, Artificial sequence
  Synthetic oligonucleotide
ctccactatcttcataaatt

SEQ ID NO: 2832 - DNA, 20 bp, Artificial sequence
  Synthetic oligonucleotide
ctcaatttggattcatctcc

SEQ ID NO: 2833 - DNA, 20 bp, Artificial sequence
  Synthetic oligonucleotide
ttcaagatatctgaaccacc

SEQ ID NO: 2834 - DNA, 20 bp, Artificial sequence
  Synthetic oligonucleotide
gctccttctgaacaaaagct

SEQ ID NO: 2835 - DNA, 20 bp, Artificial sequence
  Synthetic oligonucleotide
tgcgaatttcttgattcccc

SEQ ID NO: 2836 - DNA, 20 bp, Artificial sequence
  Synthetic oligonucleotide
ctgacttcacttcccaatca

SEQ ID NO: 2837 - DNA, 20 bp, Artificial sequence
  Synthetic oligonucleotide
ggttatttttcttaccaagc

SEQ ID NO: 2838 - DNA, 20 bp, Artificial sequence
  Synthetic oligonucleotide
ctacaatggattctcaccta

SEQ ID NO: 2839 - DNA, 20 bp, Artificial sequence
  Synthetic oligonucleotide
gcttcttaactgtttatcca

SEQ ID NO: 2840 - DNA, 20 bp, Artificial sequence
  Synthetic oligonucleotide
atatgttcttaatccaacct

SEQ ID NO: 2841 - DNA, 20 bp, Artificial sequence
  Synthetic oligonucleotide
ctcttttctccgttctctat

SEQ ID NO: 2842 - DNA, 20 bp, Artificial sequence
  Synthetic oligonucleotide
gcctttgttccctctttatt

SEQ ID NO: 2843 - DNA, 20 bp, Artificial sequence
  Synthetic oligonucleotide
cctctttatttcctactgcc

SEQ ID NO: 2844 - DNA, 20 bp, Artificial sequence
  Synthetic oligonucleotide
tgtaatggcttatttcccta

SEQ ID NO: 2845 - DNA, 20 bp, Artificial sequence
  Synthetic oligonucleotide
tgccatacttcagttgaacc

SEQ ID NO: 2846 - DNA, 20 bp, Artificial sequence
  Synthetic oligonucleotide
agcatctgcctttttatcct

SEQ ID NO: 2847 - DNA, 20 bp, Artificial sequence
  Synthetic oligonucleotide
gtctctgaattttagtatgc

SEQ ID NO: 2848 - DNA, 20 bp, Artificial sequence
  Synthetic oligonucleotide
tgttctcaattcatggtgta

SEQ ID NO: 2849 - DNA, 20 bp, Artificial sequence
  Synthetic oligonucleotide
gtacatccatctacaacatc

SEQ ID NO: 2850 - DNA, 20 bp, Artificial sequence
  Synthetic oligonucleotide
cagttctcttgctacttcta

SEQ ID NO: 2851 - DNA, 20 bp, Artificial sequence
  Synthetic oligonucleotide
agcagatatacctctcccac

SEQ ID NO: 2852 - DNA, 20 bp, Artificial sequence
  Synthetic oligonucleotide
cctgaatctcctcggccact

SEQ ID NO: 2853 - DNA, 20 bp, Artificial sequence
  Synthetic oligonucleotide
ctgcaccccctaatatgttc

SEQ ID NO: 2854 - DNA, 20 bp, Artificial sequence
  Synthetic oligonucleotide
tctctgtactatttttccaa

SEQ ID NO: 2855 - DNA, 20 bp, Artificial sequence
  Synthetic oligonucleotide
gtcaattttccccttcaccg

SEQ ID NO: 2856 - DNA, 20 bp, Artificial sequence
  Synthetic oligonucleotide
gtatctctctacagatgttt

SEQ ID NO: 2857 - DNA, 20 bp, Artificial sequence
  Synthetic oligonucleotide
gtccctcatcctctcagccc

SEQ ID NO: 2858 - DNA, 20 bp, Artificial sequence
  Synthetic oligonucleotide
gtgacagctctctatttgct

SEQ ID NO: 2859 - DNA, 20 bp, Artificial sequence
  Synthetic oligonucleotide
gctatttgtactgaactgac

SEQ ID NO: 2860 - DNA, 20 bp, Artificial sequence
  Synthetic oligonucleotide
gcttaaaccatttccaccca

SEQ ID NO: 2861 - DNA, 20 bp, Artificial sequence
  Synthetic oligonucleotide
tctcctatttctgttctcta

SEQ ID NO: 2862 - DNA, 20 bp, Artificial sequence
  Synthetic oligonucleotide
ttccctatagttattaccta

SEQ ID NO: 2863 - DNA, 20 bp, Artificial sequence
  Synthetic oligonucleotide
acatttcttctatctaccgc

SEQ ID NO: 2864 - DNA, 20 bp, Artificial sequence
  Synthetic oligonucleotide
tgtccttatttcttcaatct

SEQ ID NO: 2865 - DNA, 20 bp, Artificial sequence
  Synthetic oligonucleotide
ctgatttttttcccctcctc

SEQ ID NO: 2866 - DNA, 20 bp, Artificial sequence
  Synthetic oligonucleotide
ggatatgccagatacatatt

SEQ ID NO: 2867 - DNA, 20 bp, Artificial sequence
  Synthetic oligonucleotide
actttattttgactgacatc

SEQ ID NO: 2868 - DNA, 20 bp, Artificial sequence
  Synthetic oligonucleotide
tccattcttcctcattttca

SEQ ID NO: 2869 - DNA, 20 bp, Artificial sequence
  Synthetic oligonucleotide
ggaaacatatttcaaaatta

SEQ ID NO: 2870 - DNA, 20 bp, Artificial sequence
  Synthetic oligonucleotide
agcctgcactgattcctctt

SEQ ID NO: 2871 - DNA, 20 bp, Artificial sequence
  Synthetic oligonucleotide
tagctttgacactagcagct

SEQ ID NO: 2872 - DNA, 20 bp, Artificial sequence
  Synthetic oligonucleotide
agcattccttcttctcagca

SEQ ID NO: 2873 - DNA, 20 bp, Artificial sequence
  Synthetic oligonucleotide
gccatccatcttccccactg

SEQ ID NO: 2874 - DNA, 20 bp, Artificial sequence
  Synthetic oligonucleotide
actacacactaaatctccag

SEQ ID NO: 2875 - DNA, 20 bp, Artificial sequence
  Synthetic oligonucleotide
ctccctgacatatgaagttt

SEQ ID NO: 2876 - DNA, 20 bp, Artificial sequence
  Synthetic oligonucleotide
cttccctgctcagccatcaa

SEQ ID NO: 2877 - DNA, 20 bp, Artificial sequence
  Synthetic oligonucleotide
ccttactgatgtctattctc

SEQ ID NO: 2878 - DNA, 20 bp, Artificial sequence
  Synthetic oligonucleotide
gccacatctctatatggcgg

SEQ ID NO: 2879 - DNA, 20 bp, Artificial sequence
  Synthetic oligonucleotide
ttgtaatggcttatttccct

SEQ ID NO: 2880 - DNA, 20 bp, Artificial sequence
  Synthetic oligonucleotide
tctttatttttattatactt

SEQ ID NO: 2881 - DNA, 20 bp, Artificial sequence
  Synthetic oligonucleotide
acggccatccatcttcccca

SEQ ID NO: 2882 - DNA, 20 bp, Artificial sequence
  Synthetic oligonucleotide
ttgtaccttctacaactttt

SEQ ID NO: 2883 - DNA, 20 bp, Artificial sequence
  Synthetic oligonucleotide
tatttcaaaattaatctcaa

SEQ ID NO: 2884 - DNA, 20 bp, Artificial sequence
  Synthetic oligonucleotide
ttacctatgccacttcaact

SEQ ID NO: 2885 - DNA, 20 bp, Artificial sequence
  Synthetic oligonucleotide
gtcaacattcctttggacac

SEQ ID NO: 2886 - DNA, 20 bp, Artificial sequence
  Synthetic oligonucleotide
cctaatatgttcttaatcca

SEQ ID NO: 2887 - DNA, 20 bp, Artificial sequence
  Synthetic oligonucleotide
aggtcttggcttccacccca

SEQ ID NO: 2888 - DNA, 20 bp, Artificial sequence
  Synthetic oligonucleotide
gcactgggattcagtacgct

SEQ ID NO: 2889 - DNA, 20 bp, Artificial sequence
  Synthetic oligonucleotide
ttgcctgccatacttcagtt

SEQ ID NO: 2890 - DNA, 20 bp, Artificial sequence
  Synthetic oligonucleotide
tctgttctcaattcatggtg

SEQ ID NO: 2891 - DNA, 20 bp, Artificial sequence
  Synthetic oligonucleotide
ctggttttgataatggacta

SEQ ID NO: 2892 - DNA, 20 bp, Artificial sequence
  Synthetic oligonucleotide
gctacatttttagccttgag

SEQ ID NO: 2893 - DNA, 20 bp, Artificial sequence
  Synthetic oligonucleotide
cttcaccgatagcattcctt

SEQ ID NO: 2894 - DNA, 20 bp, Artificial sequence
  Synthetic oligonucleotide
gcttcaagcattctcagtat

SEQ ID NO: 2895 - DNA, 20 bp, Artificial sequence
  Synthetic oligonucleotide
gcacctccctgacatatgaa

SEQ ID NO: 2896 - DNA, 20 bp, Artificial sequence
  Synthetic oligonucleotide
tttccctatagttattacct

SEQ ID NO: 2897 - DNA, 20 bp, Artificial sequence
  Synthetic oligonucleotide
tgtttttctcattttagtca

SEQ ID NO: 2898 - DNA, 20 bp, Artificial sequence
  Synthetic oligonucleotide
gtatctatttccaacccaat

SEQ ID NO: 2899 - DNA, 20 bp, Artificial sequence
  Synthetic oligonucleotide
tatgctatttgtactgaact

SEQ ID NO: 2900 - DNA, 20 bp, Artificial sequence
  Synthetic oligonucleotide
tactatttttccaagttctt

SEQ ID NO: 2901 - DNA, 20 bp, Artificial sequence
  Synthetic oligonucleotide
ctccattcttcctcattttc

SEQ ID NO: 2902 - DNA, 20 bp, Artificial sequence
  Synthetic oligonucleotide
cctagcctgcactgattcct

SEQ ID NO: 2903 - DNA, 20 bp, Artificial sequence
  Synthetic oligonucleotide
ctctctgtactatttttcca

SEQ ID NO: 2904 - DNA, 20 bp, Artificial sequence
  Synthetic oligonucleotide
acttcatcctgaatctcctc

SEQ ID NO: 2905 - DNA, 20 bp, Artificial sequence
  Synthetic oligonucleotide
tctgacattttcactgatcg

SEQ ID NO: 2906 - DNA, 20 bp, Artificial sequence
  Synthetic oligonucleotide
gtcacacctatgttcttata

SEQ ID NO: 2907 - DNA, 20 bp, Artificial sequence
  Synthetic oligonucleotide
cttcttctcagcatgactcc

SEQ ID NO: 2908 - DNA, 20 bp, Artificial sequence
  Synthetic oligonucleotide
actgattcctctttttctct

SEQ ID NO: 2909 - DNA, 20 bp, Artificial sequence
  Synthetic oligonucleotide
acatctgatttttgcacccc

SEQ ID NO: 2910 - DNA, 20 bp, Artificial sequence
  Synthetic oligonucleotide
cttcctcattttcacccata

SEQ ID NO: 2911 - DNA, 20 bp, Artificial sequence
  Synthetic oligonucleotide
tgatgtctattctccaagta

SEQ ID NO: 2912 - DNA, 20 bp, Artificial sequence
  Synthetic oligonucleotide
gtgtccttatttcttcaatc

SEQ ID NO: 2913 - DNA, 20 bp, Artificial sequence
  Synthetic oligonucleotide
ttgcacatcatttacccttt

SEQ ID NO: 2914 - DNA, 20 bp, Artificial sequence
  Synthetic oligonucleotide
gcatgactccattcttcctc

SEQ ID NO: 2915 - DNA, 20 bp, Artificial sequence
  Synthetic oligonucleotide
gcactatatttacagattcc

SEQ ID NO: 2916 - DNA, 20 bp, Artificial sequence
  Synthetic oligonucleotide
cccagaaaagctattctccc

SEQ ID NO: 2917 - DNA, 20 bp, Artificial sequence
  Synthetic oligonucleotide
acatggttttcctgagccta

SEQ ID NO: 2918 - DNA, 20 bp, Artificial sequence
  Synthetic oligonucleotide
gcatgcattttttttctatg

SEQ ID NO: 2919 - DNA, 20 bp, Artificial sequence
  Synthetic oligonucleotide
actgcattaagcacatccta

SEQ ID NO: 2920 - DNA, 20 bp, Artificial sequence
  Synthetic oligonucleotide
gttgctccttctgaacaaaa

SEQ ID NO: 2921 - DNA, 20 bp, Artificial sequence
  Synthetic oligonucleotide
gcatcctttcattattgcga

SEQ ID NO: 2922 - DNA, 20 bp, Artificial sequence
  Synthetic oligonucleotide
ccacagtccctcatcctctc

SEQ ID NO: 2923 - DNA, 20 bp, Artificial sequence
  Synthetic oligonucleotide
acgcaaaattctctgctgcc

SEQ ID NO: 2924 - DNA, 20 bp, Artificial sequence
  Synthetic oligonucleotide
gctacaatggattctcacct

SEQ ID NO: 2925 - DNA, 20 bp, Artificial sequence
  Synthetic oligonucleotide
tgtcaattttccccttcacc

SEQ ID NO: 2926 - DNA, 20 bp, Artificial sequence
  Synthetic oligonucleotide
tgcaaacttctctttctata

SEQ ID NO: 2927 - DNA, 20 bp, Artificial sequence
  Synthetic oligonucleotide
gatagcattccttcttctca

SEQ ID NO: 2928 - DNA, 20 bp, Artificial sequence
  Synthetic oligonucleotide
cccacttcatcagtccaagt

SEQ ID NO: 2929 - DNA, 20 bp, Artificial sequence
  Synthetic oligonucleotide
gtataatttcagattccgtc

SEQ ID NO: 2930 - DNA, 20 bp, Artificial sequence
  Synthetic oligonucleotide
gctcttttctccgttctcta

SEQ ID NO: 2931 - DNA, 20 bp, Artificial sequence
  Synthetic oligonucleotide
gttggtagactacacactaa

SEQ ID NO: 2932 - DNA, 20 bp, Artificial sequence
  Synthetic oligonucleotide
gttgctttttttctcttctt

SEQ ID NO: 2933 - DNA, 20 bp, Artificial sequence
  Synthetic oligonucleotide
accattgtatctctctacag

SEQ ID NO: 2934 - DNA, 20 bp, Artificial sequence
  Synthetic oligonucleotide
attcaagatatctgaaccac

SEQ ID NO: 2935 - DNA, 20 bp, Artificial sequence
  Synthetic oligonucleotide
gttgcgatttagtaattcac

SEQ ID NO: 2936 - DNA, 20 bp, Artificial sequence
  Synthetic oligonucleotide
ttctcctatttctgttctct

SEQ ID NO: 2937 - DNA, 20 bp, Artificial sequence
  Synthetic oligonucleotide
gggtacatccatctacaaca

SEQ ID NO: 2938 - DNA, 20 bp, Artificial sequence
  Synthetic oligonucleotide
ccctctttatttcctactgc

SEQ ID NO: 2939 - DNA, 20 bp, Artificial sequence
  Synthetic oligonucleotide
tgtggtattttattctcttt

SEQ ID NO: 2940 - DNA, 20 bp, Artificial sequence
  Synthetic oligonucleotide
atgcctttgttccctcttta

SEQ ID NO: 2941 - DNA, 20 bp, Artificial sequence
  Synthetic oligonucleotide
actgatttttttcccctcct

SEQ ID NO: 2942 - DNA, 20 bp, Artificial sequence
  Synthetic oligonucleotide
aggttccttactgatgtcta

SEQ ID NO: 2943 - DNA, 20 bp, Artificial sequence
  Synthetic oligonucleotide
aagcagatatacctctccca

SEQ ID NO: 2944 - DNA, 20 bp, Artificial sequence
  Synthetic oligonucleotide
cctccactatcttcataaat

SEQ ID NO: 2945 - DNA, 20 bp, Artificial sequence
  Synthetic oligonucleotide
gcttccctgctcagccatca

SEQ ID NO: 2946 - DNA, 20 bp, Artificial sequence
  Synthetic oligonucleotide
cccaggttatttttcttacc

SEQ ID NO: 2947 - DNA, 20 bp, Artificial sequence
  Synthetic oligonucleotide
cccatatgctgcctttgtgt

SEQ ID NO: 2948 - DNA, 20 bp, Artificial sequence
  Synthetic oligonucleotide
tcttgccatgtttcccattc

SEQ ID NO: 2949 - DNA, 20 bp, Artificial sequence
  Synthetic oligonucleotide
gcacaaacttctatacaaaa

SEQ ID NO: 2950 - DNA, 20 bp, Artificial sequence
  Synthetic oligonucleotide
gtgtctctgaattttagtat

SEQ ID NO: 2951 - DNA, 20 bp, Artificial sequence
  Synthetic oligonucleotide
gacatttcttctatctaccg

SEQ ID NO: 2952 - DNA, 20 bp, Artificial sequence
  Synthetic oligonucleotide
tggtctgacttcacttccca

SEQ ID NO: 2953 - DNA, 20 bp, Artificial sequence
  Synthetic oligonucleotide
tctgattccagatgataacc

SEQ ID NO: 2954 - DNA, 20 bp, Artificial sequence
  Synthetic oligonucleotide
tctcaatttggattcatctc

SEQ ID NO: 2955 - DNA, 20 bp, Artificial sequence
  Synthetic oligonucleotide
gctccatccatttggttgag

SEQ ID NO: 2956 - DNA, 20 bp, Artificial sequence
  Synthetic oligonucleotide
ctgaagcagatatacctctc

SEQ ID NO: 2957 - DNA, 20 bp, Artificial sequence
  Synthetic oligonucleotide
acacttatttaatacatagt

SEQ ID NO: 2958 - DNA, 20 bp, Artificial sequence
  Synthetic oligonucleotide
gtcattatcaatgacttcca

SEQ ID NO: 2959 - DNA, 20 bp, Artificial sequence
  Synthetic oligonucleotide
ttgactgcattaagcacatc

SEQ ID NO: 2960 - DNA, 20 bp, Artificial sequence
  Synthetic oligonucleotide
gctcaaagtataatttcaga

SEQ ID NO: 2961 - DNA, 20 bp, Artificial sequence
  Synthetic oligonucleotide
ttgcaaacttctctttctat

SEQ ID NO: 2962 - DNA, 20 bp, Artificial sequence
  Synthetic oligonucleotide
cacctccactatcttcataa

SEQ ID NO: 2963 - DNA, 20 bp, Artificial sequence
  Synthetic oligonucleotide
tttcctactgcctttctcat

SEQ ID NO: 2964 - DNA, 20 bp, Artificial sequence
  Synthetic oligonucleotide
gttcattcccctagcctgca

SEQ ID NO: 2965 - DNA, 20 bp, Artificial sequence
  Synthetic oligonucleotide
ctctgttctcaattcatggt

SEQ ID NO: 2966 - DNA, 20 bp, Artificial sequence
  Synthetic oligonucleotide
ctgtgtccttatttcttcaa

SEQ ID NO: 2967 - DNA, 20 bp, Artificial sequence
  Synthetic oligonucleotide
ttatgcctttgttccctctt

SEQ ID NO: 2968 - DNA, 20 bp, Artificial sequence
  Synthetic oligonucleotide
gcagctttttttttttcttt

SEQ ID NO: 2969 - DNA, 20 bp, Artificial sequence
  Synthetic oligonucleotide
ctccacagtccctcatcctc

SEQ ID NO: 2970 - DNA, 20 bp, Artificial sequence
  Synthetic oligonucleotide
cttcagttcattaagactga

SEQ ID NO: 2971 - DNA, 20 bp, Artificial sequence
  Synthetic oligonucleotide
agcatgactccattcttcct

SEQ ID NO: 2972 - DNA, 20 bp, Artificial sequence
  Synthetic oligonucleotide
cttgttctcctatttctgtt

SEQ ID NO: 2973 - DNA, 20 bp, Artificial sequence
  Synthetic oligonucleotide
tcctggttttgataatggac

SEQ ID NO: 2974 - DNA, 20 bp, Artificial sequence
  Synthetic oligonucleotide
aaccattgtatctctctaca

SEQ ID NO: 2975 - DNA, 20 bp, Artificial sequence
  Synthetic oligonucleotide
ctgtgcttcacttggcccca

SEQ ID NO: 2976 - DNA, 20 bp, Artificial sequence
  Synthetic oligonucleotide
atctcaatttggattcatct

SEQ ID NO: 2977 - DNA, 20 bp, Artificial sequence
  Synthetic oligonucleotide
gcttatttccctatagttat

SEQ ID NO: 2978 - DNA, 20 bp, Artificial sequence
  Synthetic oligonucleotide
tccctctttatttcctactg

SEQ ID NO: 2979 - DNA, 20 bp, Artificial sequence
  Synthetic oligonucleotide
ctttcatgttcccttgagga

SEQ ID NO: 2980 - DNA, 20 bp, Artificial sequence
  Synthetic oligonucleotide
ccttcttctcagcatgactc

SEQ ID NO: 2981 - DNA, 20 bp, Artificial sequence
  Synthetic oligonucleotide
gccagctgttcccttgagcg

SEQ ID NO: 2982 - DNA, 20 bp, Artificial sequence
  Synthetic oligonucleotide
ttcttcctcattttcaccca

SEQ ID NO: 2983 - DNA, 20 bp, Artificial sequence
  Synthetic oligonucleotide
agttgctttttttctcttct

SEQ ID NO: 2984 - DNA, 20 bp, Artificial sequence
  Synthetic oligonucleotide
ctgggcatggtatttgcaat

SEQ ID NO: 2985 - DNA, 20 bp, Artificial sequence
  Synthetic oligonucleotide
cgatagcattccttcttctc

SEQ ID NO: 2986 - DNA, 20 bp, Artificial sequence
  Synthetic oligonucleotide
catcaactttttagtccttt

SEQ ID NO: 2987 - DNA, 20 bp, Artificial sequence
  Synthetic oligonucleotide
gtatgctatttgtactgaac

SEQ ID NO: 2988 - DNA, 20 bp, Artificial sequence
  Synthetic oligonucleotide
atgtcaattttccccttcac

SEQ ID NO: 2989 - DNA, 20 bp, Artificial sequence
  Synthetic oligonucleotide
gcccacttcatcagtccaag

SEQ ID NO: 2990 - DNA, 20 bp, Artificial sequence
  Synthetic oligonucleotide
gcatattacatggttttcct

SEQ ID NO: 2991 - DNA, 20 bp, Artificial sequence
  Synthetic oligonucleotide
tgtatctatttccaacccaa

SEQ ID NO: 2992 - DNA, 20 bp, Artificial sequence
  Synthetic oligonucleotide
gttccagcctgacagtttca

SEQ ID NO: 2993 - DNA, 20 bp, Artificial sequence
  Synthetic oligonucleotide
cctctctgtactatttttcc

SEQ ID NO: 2994 - DNA, 20 bp, Artificial sequence
  Synthetic oligonucleotide
actgagttgctccttctgaa

SEQ ID NO: 2995 - DNA, 20 bp, Artificial sequence
  Synthetic oligonucleotide
actgtggtctgacttcactt

SEQ ID NO: 2996 - DNA, 20 bp, Artificial sequence
  Synthetic oligonucleotide
gctgcatttttcctgaagag

SEQ ID NO: 2997 - DNA, 20 bp, Artificial sequence
  Synthetic oligonucleotide
gcatcaattcctttgggttt

SEQ ID NO: 2998 - DNA, 20 bp, Artificial sequence
  Synthetic oligonucleotide
acaacttttgtttttctcat

SEQ ID NO: 2999 - DNA, 20 bp, Artificial sequence
  Synthetic oligonucleotide
gctctgattccagatgataa

SEQ ID NO: 3000 - DNA, 20 bp, Artificial sequence
  Synthetic oligonucleotide
actcatgcttttaggagcat

SEQ ID NO: 3001 - DNA, 20 bp, Artificial sequence
  Synthetic oligonucleotide
atatttcaaaattaatctca

SEQ ID NO: 3002 - DNA, 20 bp, Artificial sequence
  Synthetic oligonucleotide
atgtggtattttattctctt

SEQ ID NO: 3003 - DNA, 20 bp, Artificial sequence
  Synthetic oligonucleotide
gccacagtagagtatagtat

SEQ ID NO: 3004 - DNA, 20 bp, Artificial sequence
  Synthetic oligonucleotide
gttctttatttttattatac

SEQ ID NO: 3005 - DNA, 20 bp, Artificial sequence
  Synthetic oligonucleotide
gcaggtcttggcttccaccc

SEQ ID NO: 3006 - DNA, 20 bp, Artificial sequence
  Synthetic oligonucleotide
tggttagtttgcttcaagca

SEQ ID NO: 3007 - DNA, 20 bp, Artificial sequence
  Synthetic oligonucleotide
ggtcttgccatgtttcccat

SEQ ID NO: 3008 - DNA, 20 bp, Artificial sequence
  Synthetic oligonucleotide
ctgatgtctattctccaagt

SEQ ID NO: 3009 - DNA, 20 bp, Artificial sequence
  Synthetic oligonucleotide
agctcttttctccgttctct

SEQ ID NO: 3010 - DNA, 20 bp, Artificial sequence
  Synthetic oligonucleotide
cactgatttttttcccctcc

SEQ ID NO: 3011 - DNA, 20 bp, Artificial sequence
  Synthetic oligonucleotide
gcctcaggctccatccattt

SEQ ID NO: 3012 - DNA, 20 bp, Artificial sequence
  Synthetic oligonucleotide
acatattgcttatatgttgg

SEQ ID NO: 3013 - DNA, 20 bp, Artificial sequence
  Synthetic oligonucleotide
gtactatttttccaagttct

SEQ ID NO: 3014 - DNA, 20 bp, Artificial sequence
  Synthetic oligonucleotide
gccagtgtctctgaatttta

SEQ ID NO: 3015 - DNA, 20 bp, Artificial sequence
  Synthetic oligonucleotide
cccttcaccgatagcattcc

SEQ ID NO: 3016 - DNA, 20 bp, Artificial sequence
  Synthetic oligonucleotide
atgcatcacggccatccatc

SEQ ID NO: 3017 - DNA, 20 bp, Artificial sequence
  Synthetic oligonucleotide
atgcatgcattttttttcta

SEQ ID NO: 3018 - DNA, 20 bp, Artificial sequence
  Synthetic oligonucleotide
actccattcttcctcatttt

SEQ ID NO: 3019 - DNA, 20 bp, Artificial sequence
  Synthetic oligonucleotide
gttattacctatgccacttc

SEQ ID NO: 3020 - DNA, 20 bp, Artificial sequence
  Synthetic oligonucleotide
accgtactttgccattcatt

SEQ ID NO: 3021 - DNA, 20 bp, Artificial sequence
  Synthetic oligonucleotide
gcttgtatttataagcacaa

SEQ ID NO: 3022 - DNA, 20 bp, Artificial sequence
  Synthetic oligonucleotide
ccctaatatgttcttaatcc

SEQ ID NO: 3023 - DNA, 20 bp, Artificial sequence
  Synthetic oligonucleotide
tggcttccctgctcagccat

SEQ ID NO: 3024 - DNA, 20 bp, Artificial sequence
  Synthetic oligonucleotide
actgcacctccctgacatat

SEQ ID NO: 3025 - DNA, 20 bp, Artificial sequence
  Synthetic oligonucleotide
gcccaggttatttttcttac

SEQ ID NO: 3026 - DNA, 20 bp, Artificial sequence
  Synthetic oligonucleotide
tgggcttcatttaggctcac

SEQ ID NO: 3027 - DNA, 20 bp, Artificial sequence
  Synthetic oligonucleotide
ctgcaatttctctataatct

SEQ ID NO: 3028 - DNA, 20 bp, Artificial sequence
  Synthetic oligonucleotide
gctgatattcatgttctctt

SEQ ID NO: 3029 - DNA, 20 bp, Artificial sequence
  Synthetic oligonucleotide
gttcaatttcttcaactgta

SEQ ID NO: 3030 - DNA, 20 bp, Artificial sequence
  Synthetic oligonucleotide
cactgattcctctttttctc

SEQ ID NO: 3031 - DNA, 20 bp, Artificial sequence
  Synthetic oligonucleotide
aggactatagatgacaacta

SEQ ID NO: 3032 - DNA, 20 bp, Artificial sequence
  Synthetic oligonucleotide
atcccacttcccattctgga

SEQ ID NO: 3033 - DNA, 20 bp, Artificial sequence
  Synthetic oligonucleotide
ggcatcacttacaaactcac

SEQ ID NO: 3034 - DNA, 20 bp, Artificial sequence
  Synthetic oligonucleotide
tcttgatatttgtcaaccca

SEQ ID NO: 3035 - DNA, 20 bp, Artificial sequence
  Synthetic oligonucleotide
cttgatatttgtcaacccag

SEQ ID NO: 3036 - DNA, 20 bp, Artificial sequence
  Synthetic oligonucleotide
gtcttgatatttgtcaaccc

SEQ ID NO: 3037 - DNA, 20 bp, Artificial sequence
  Synthetic oligonucleotide
tgatatttgtcaacccagaa

SEQ ID NO: 3038 - DNA, 20 bp, Artificial sequence
  Synthetic oligonucleotide
gaagcttacatcattttctt

SEQ ID NO: 3039 - DNA, 20 bp, Artificial sequence
  Synthetic oligonucleotide
aagcttacatcattttcttg

SEQ ID NO: 3040 - DNA, 20 bp, Artificial sequence
  Synthetic oligonucleotide
atggatctgaatcccacttc

SEQ ID NO: 3041 - DNA, 20 bp, Artificial sequence
  Synthetic oligonucleotide
acttacaaactcaccaacta

SEQ ID NO: 3042 - DNA, 20 bp, Artificial sequence
  Synthetic oligonucleotide
cttacaaactcaccaactaa

SEQ ID NO: 3043 - DNA, 20 bp, Artificial sequence
  Synthetic oligonucleotide
tgttccaaagattccacttt

SEQ ID NO: 3044 - DNA, 20 bp, Artificial sequence
  Synthetic oligonucleotide
gttccaaagattccactttc

SEQ ID NO: 3045 - DNA, 20 bp, Artificial sequence
  Synthetic oligonucleotide
ttccaaagattccactttct

SEQ ID NO: 3046 - DNA, 20 bp, Artificial sequence
  Synthetic oligonucleotide
ttacatcattttcttgcagt

SEQ ID NO: 3047 - DNA, 20 bp, Artificial sequence
  Synthetic oligonucleotide
tggtttacctttaacattcc

SEQ ID NO: 3048 - DNA, 20 bp, Artificial sequence
  Synthetic oligonucleotide
ggtttacctttaacattcct

SEQ ID NO: 3049 - DNA, 20 bp, Artificial sequence
  Synthetic oligonucleotide
tttacctttaacattcctca

SEQ ID NO: 3050 - DNA, 20 bp, Artificial sequence
  Synthetic oligonucleotide
ttacctttaacattcctcat

SEQ ID NO: 3051 - DNA, 20 bp, Artificial sequence
  Synthetic oligonucleotide
tctctcatagtcttaattcc

SEQ ID NO: 3052 - DNA, 20 bp, Artificial sequence
  Synthetic oligonucleotide
tctcatagtcttaattccca

SEQ ID NO: 3053 - DNA, 20 bp, Artificial sequence
  Synthetic oligonucleotide
tccaattttaacttgcacca

SEQ ID NO: 3054 - DNA, 20 bp, Artificial sequence
  Synthetic oligonucleotide
ttcacagtttaccccaagct

SEQ ID NO: 3055 - DNA, 20 bp, Artificial sequence
  Synthetic oligonucleotide
tcacagtttaccccaagctt

SEQ ID NO: 3056 - DNA, 20 bp, Artificial sequence
  Synthetic oligonucleotide
cattctcttatattccttac

SEQ ID NO: 3057 - DNA, 20 bp, Artificial sequence
  Synthetic oligonucleotide
atatttgtcaacccagaacc

SEQ ID NO: 3058 - DNA, 23 bp, Artificial sequence
  Synthetic oligonucleotide
  misc_feature (2)..(23): bases at these postions are RNA
tgaacuuguagguuggauuuucg

SEQ ID NO: 3059 - DNA, 23 bp, Artificial sequence
  Synthetic oligonucleotide
  misc_feature (2)..(23): bases at these postions are RNA
taauuuauuuauguaauacagug

SEQ ID NO: 3060 - DNA, 23 bp, Artificial sequence
  Synthetic oligonucleotide
  misc_feature (2)..(23): bases at these postions are RNA
taagaaacaaacguguguauccu

SEQ ID NO: 3061 - DNA, 23 bp, Artificial sequence
  Synthetic oligonucleotide
  misc_feature (2)..(23): bases at these postions are RNA
tgagacugauucaugcgcucaua

SEQ ID NO: 3062 - DNA, 23 bp, Artificial sequence
  Synthetic oligonucleotide
  misc_feature (2)..(23): bases at these postions are RNA
tucugaaauacuuaaaaauguuu

SEQ ID NO: 3063 - DNA, 23 bp, Artificial sequence
  Synthetic oligonucleotide
  misc_feature (2)..(23): bases at these postions are RNA
tgggcaucacuuacaaacucacc

SEQ ID NO: 3064 - RNA, 21 nt, Artificial sequence
  Synthetic oligonucleotide
aaaauccaaccuacaaguuca

SEQ ID NO: 3065 - RNA, 21 nt, Artificial sequence
  Synthetic oligonucleotide
cuguauuacauaaauaaauua

SEQ ID NO: 3066 - RNA, 21 nt, Artificial sequence
  Synthetic oligonucleotide
gauacacacguuuguuucuua

SEQ ID NO: 3067 - RNA, 21 nt, Artificial sequence
  Synthetic oligonucleotide
ugagcgcaugaaucagucuca

SEQ ID NO: 3068 - RNA, 21 nt, Artificial sequence
  Synthetic oligonucleotide
acauuuuuaaguauuucagaa

SEQ ID NO: 3069 - RNA, 21 nt, Artificial sequence
  Synthetic oligonucleotide
ugaguuuguaagugaugccca

SEQ ID NO: 3070 - DNA, 18 bp, Artificial sequence
  Synthetic oligonucleotide
tcatgtgcatgttcagtc

SEQ ID NO: 3071 - DNA, 20 bp, Artificial sequence
  Synthetic oligonucleotide
tgtcactttcttcagccagt

SEQ ID NO: 3072 - DNA, 18 bp, Artificial sequence
  Synthetic oligonucleotide
cttccttggtatcaatgc

SEQ ID NO: 3073 - DNA, 18 bp, Artificial sequence
  Synthetic oligonucleotide
gatacttgtcaacggcat

The invention claimed is:
1. A modified oligonucleotide according to the following chemical structure:
(SEQ ID NO: 452)
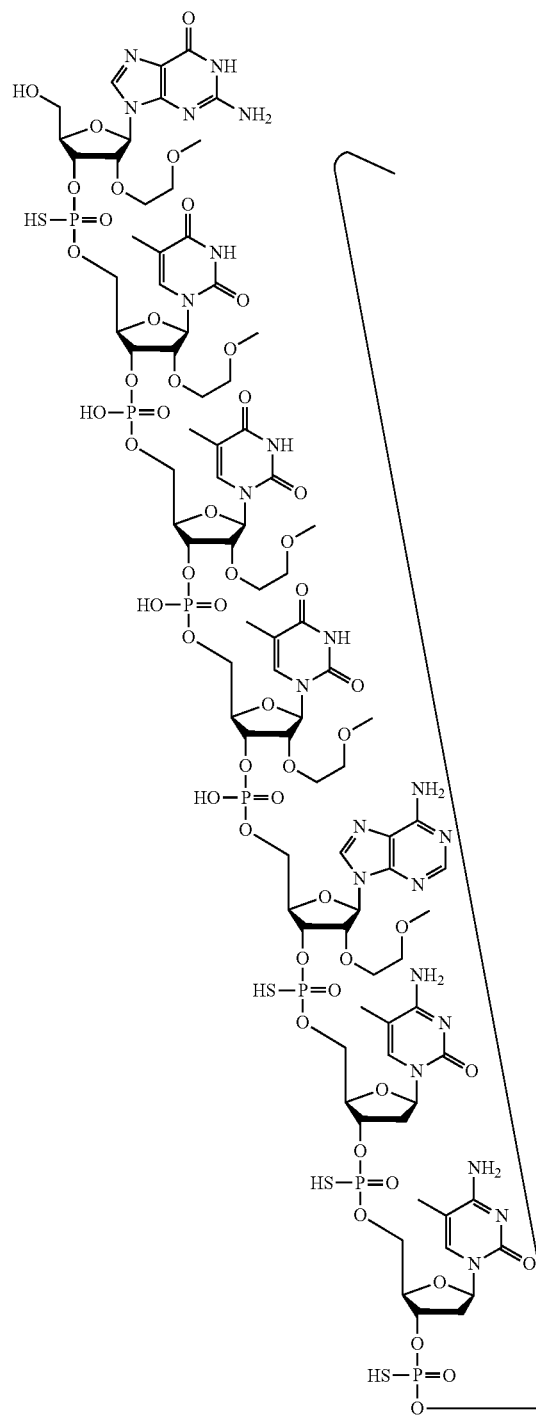
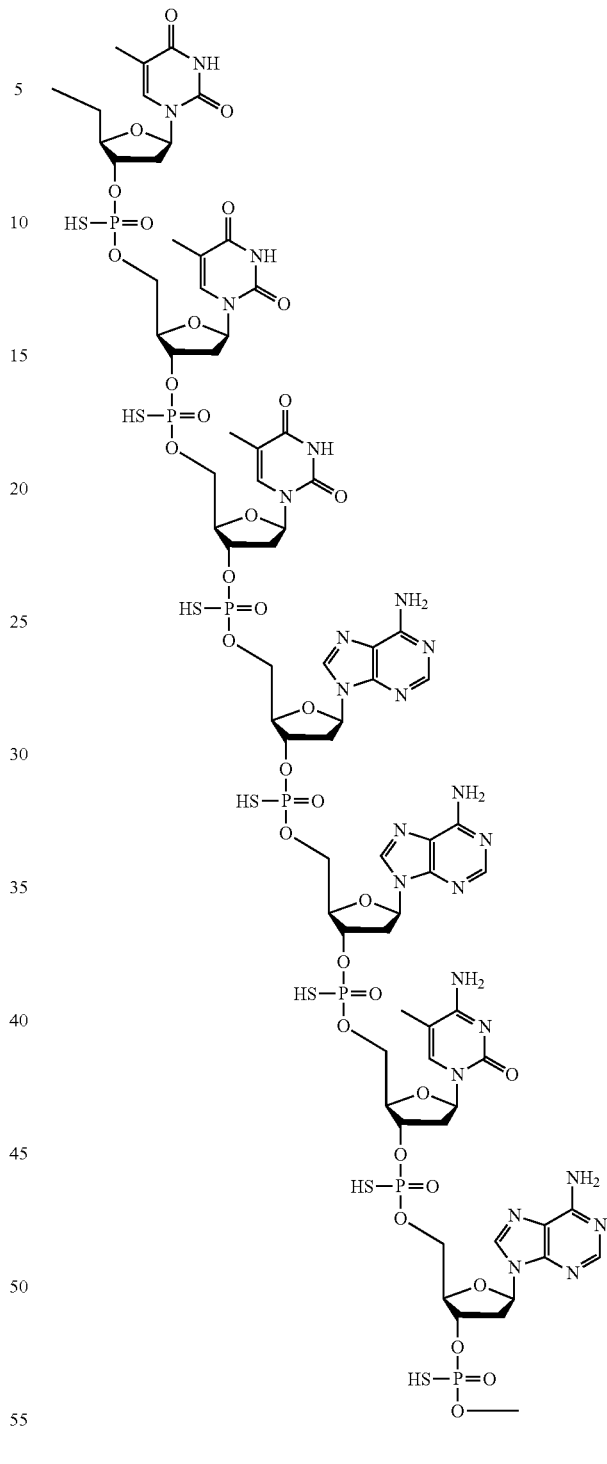

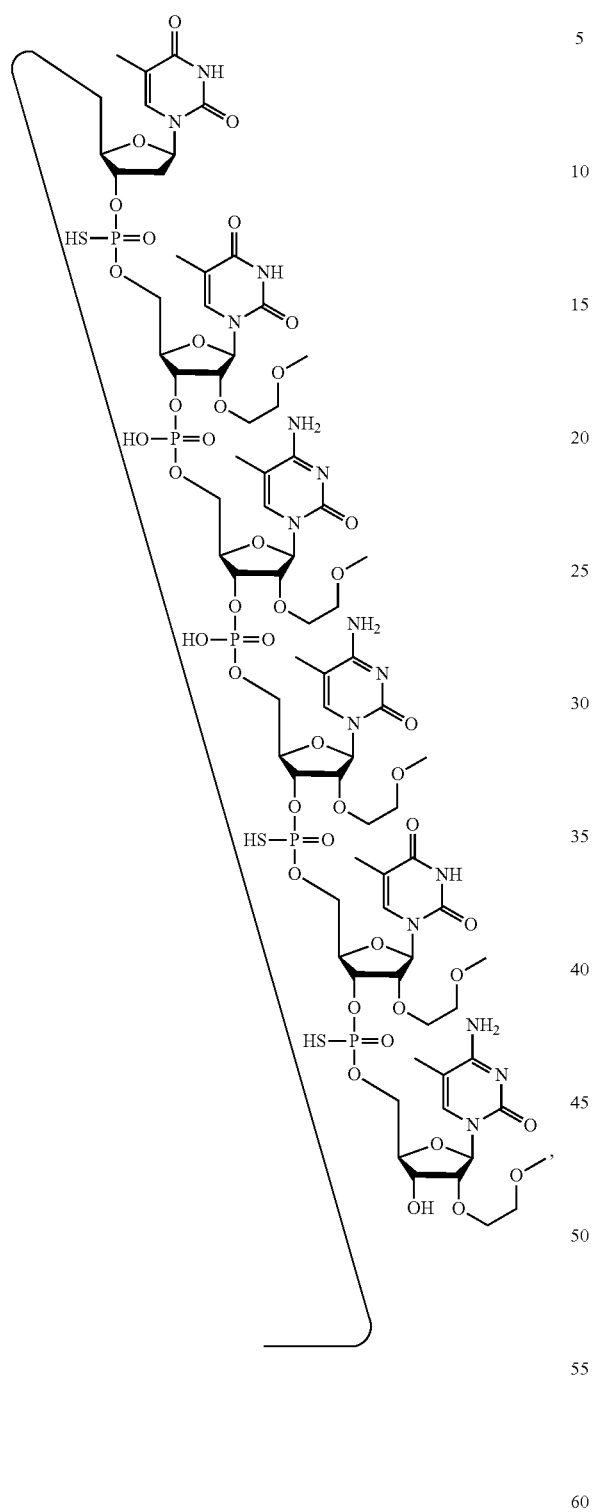
or a pharmaceutically acceptable salt thereof.
2. The modified oligonucleotide of claim 1, which is the sodium salt or the potassium salt.

3. A modified oligonucleotide according to the following chemical structure:

(SEQ ID NO: 452)

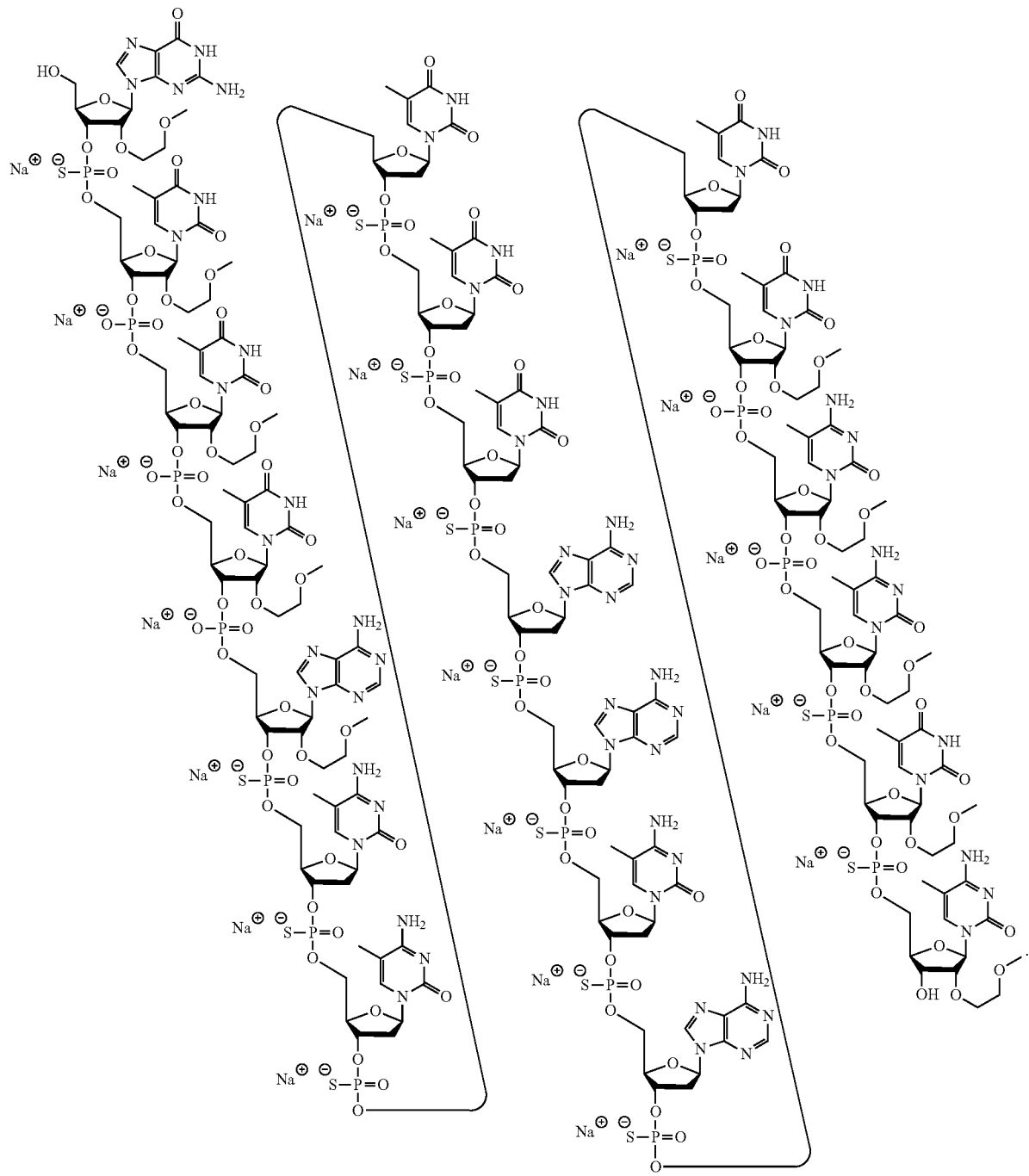

4. An oligomeric compound comprising a modified oligonucleotide according to the following chemical notation: G$_{es}$T$_{eo}$T$_{eo}$T$_{eo}$A$_{es}$$^{m}$C$_{ds}$$^{m}$C$_{ds}$T$_{ds}$T$_{ds}$T$_{ds}$A$_{ds}$A$_{ds}$$^{m}$C$_{ds}$A$_{ds}$T$_{ds}$T$_{eo}$$^{m}$C$_{eo}$$^{m}$C$_{es}$T$_{es}$$^{m}$C$_{e}$ (SEQ ID NO: 452), wherein:

A=an adenine nucleobase,
$^{m}$C=a 5-methylcytosine nucleobase,
G=a guanine nucleobase,
T=a thymine nucleobase,
e=a 2'-O(CH$_2$)$_2$OCH$_3$ ribosyl sugar moiety,
d=a 2'-β-D deoxyribosyl sugar moiety,
s=a phosphorothioate internucleoside linkage, and
o=a phosphodiester internucleoside linkage.

5. A population of modified oligonucleotides of claim 1, wherein all of the phosphorothioate internucleoside linkages of the modified oligonucleotide are stereorandom.

6. A pharmaceutical composition comprising a modified oligonucleotide of claim 1 and a pharmaceutically acceptable diluent.

7. The pharmaceutical composition of claim 6, wherein the pharmaceutically acceptable diluent is artificial cerebrospinal fluid or phosphate-buffered saline (PBS).

8. The pharmaceutical composition of claim 7, wherein the pharmaceutical composition consists essentially of the modified oligonucleotide and artificial cerebrospinal fluid.

9. The pharmaceutical composition of claim 7, wherein the pharmaceutical composition consists essentially of the modified oligonucleotide and PBS.

10. A pharmaceutical composition comprising the modified oligonucleotide of claim 2 and a pharmaceutically acceptable diluent.

11. The pharmaceutical composition of claim 10, wherein the pharmaceutically acceptable diluent is artificial cerebrospinal fluid or phosphate-buffered saline (PBS).

12. The pharmaceutical composition of claim 11, wherein the pharmaceutical composition consists essentially of the modified oligonucleotide and artificial cerebrospinal fluid.

13. The pharmaceutical composition of claim 11, wherein the pharmaceutical composition consists essentially of the modified oligonucleotide and PBS.

14. A pharmaceutical composition comprising the modified oligonucleotide of claim 3 and a pharmaceutically acceptable diluent.

15. The pharmaceutical composition of claim 14, wherein the pharmaceutically acceptable diluent is artificial cerebrospinal fluid or phosphate-buffered saline (PBS).

16. The pharmaceutical composition of claim 15, wherein the pharmaceutical composition consists essentially of the modified oligonucleotide and artificial cerebrospinal fluid.

17. The pharmaceutical composition of claim 15, wherein the pharmaceutical composition consists essentially of the modified oligonucleotide and PBS.

18. A pharmaceutical composition comprising the oligomeric compound of claim 4 and a pharmaceutically acceptable diluent.

19. The pharmaceutical composition of claim 18, wherein the pharmaceutically acceptable diluent is artificial cerebrospinal fluid or phosphate-buffered saline (PBS).

20. The pharmaceutical composition of claim 19, wherein the pharmaceutical composition consists essentially of the oligomeric compound and artificial cerebrospinal fluid.

21. The pharmaceutical composition of claim 19, wherein the pharmaceutical composition consists essentially of the oligomeric compound and PBS.

22. A population of modified oligonucleotides of claim 2, wherein all of the phosphorothioate internucleoside linkages of the modified oligonucleotide are stereorandom.

23. A population of modified oligonucleotides of claim 3, wherein all of the phosphorothioate internucleoside linkages of the modified oligonucleotide are stereorandom.

24. A population of oligomeric compounds of claim 4, wherein all of the phosphorothioate internucleoside linkages of the modified oligonucleotide are stereorandom.

25. A pharmaceutical composition comprising the population of modified oligonucleotides of claim 5 and a pharmaceutically acceptable diluent.

26. A pharmaceutical composition comprising the population of modified oligonucleotides of claim 22 and a pharmaceutically acceptable diluent.

27. A pharmaceutical composition comprising the population of modified oligonucleotides of claim 23 and a pharmaceutically acceptable diluent.

28. A pharmaceutical composition comprising the population of oligomeric compounds of claim 24 and a pharmaceutically acceptable diluent.

29. The pharmaceutical composition of claim 25, wherein the pharmaceutically acceptable diluent is artificial cerebrospinal fluid or phosphate-buffered saline (PBS).

30. The pharmaceutical composition of claim 26, wherein the pharmaceutically acceptable diluent is artificial cerebrospinal fluid or phosphate-buffered saline (PBS).

31. The pharmaceutical composition of claim 27, wherein the pharmaceutically acceptable diluent is artificial cerebrospinal fluid or phosphate-buffered saline (PBS).

32. The pharmaceutical composition of claim 28, wherein the pharmaceutically acceptable diluent is artificial cerebrospinal fluid or phosphate-buffered saline (PBS).

* * * * *